(12) United States Patent
Aponte et al.

(10) Patent No.: US 11,959,086 B2
(45) Date of Patent: Apr. 16, 2024

(54) DUAL TRANSIT PEPTIDES FOR TARGETING POLYPEPTIDES

(71) Applicant: BASF AGRO B.V., Arnhem (NL)

(72) Inventors: Raphael Aponte, Limburgerhof (DE); Stefan Tresch, Ludwigshafen (DE); Tobias Seiser, Limburgerhof (DE); Jill M. Paulik, Research Triangle Park, NC (US)

(73) Assignee: BASF AGRO B.V., Arnhem (NL)

( * ) Notice: Subject to any disclaimer, the term of this patent is extended or adjusted under 35 U.S.C. 154(b) by 0 days.

(21) Appl. No.: 16/302,202

(22) PCT Filed: May 19, 2017

(86) PCT No.: PCT/EP2017/062182
§ 371 (c)(1),
(2) Date: Nov. 16, 2018

(87) PCT Pub. No.: WO2017/198859
PCT Pub. Date: Nov. 23, 2017

(65) Prior Publication Data
US 2019/0169626 A1    Jun. 6, 2019

(30) Foreign Application Priority Data
May 20, 2016 (EP) .................................. 16170705

(51) Int. Cl.
| A01H 1/00 | (2006.01) |
| A01H 5/00 | (2018.01) |
| C12N 15/82 | (2006.01) |

(52) U.S. Cl.
CPC ........... *C12N 15/8221* (2013.01); *A01H 1/00* (2013.01); *A01H 5/00* (2013.01); *C12N 15/8234* (2013.01); *C12N 15/8274* (2013.01)

(58) Field of Classification Search
None
See application file for complete search history.

(56) References Cited

U.S. PATENT DOCUMENTS

| 4,940,935 A | 7/1990 | Riley |
| 4,945,050 A | 7/1990 | Sanford et al. |
| 5,169,770 A | 12/1992 | Chee et al. |
| 5,188,642 A | 2/1993 | Shah et al. |
| 5,268,463 A | 12/1993 | Jefferson |
| 5,276,268 A | 1/1994 | Strauch et al. |
| 5,322,783 A | 6/1994 | Tomes et al. |
| 5,349,127 A | 9/1994 | Dean et al. |
| 5,366,892 A | 11/1994 | Foncerrada et al. |
| 5,376,543 A | 12/1994 | Chee et al. |
| 5,380,831 A | 1/1995 | Adang et al. |
| 5,399,680 A | 3/1995 | Zhu et al. |
| 5,424,412 A | 6/1995 | Brown et al. |
| 5,436,391 A | 7/1995 | Fujimoto et al. |
| 5,466,785 A | 11/1995 | de Framond |
| 5,561,236 A | 10/1996 | Leemans et al. |
| 5,565,350 A | 10/1996 | Kmiec |
| 5,569,597 A | 10/1996 | Grimsley et al. |
| 5,593,874 A | 1/1997 | Brown et al. |
| 5,593,881 A | 1/1997 | Thompson et al. |
| 5,602,321 A | 2/1997 | John |
| 5,604,121 A | 2/1997 | Hilder et al. |
| 5,605,794 A | 2/1997 | Rust et al. |
| 5,605,796 A | 2/1997 | Chen et al. |
| 5,605,798 A | 2/1997 | Koster |
| 5,605,800 A | 2/1997 | Kourilsky et al. |
| 5,608,142 A | 3/1997 | Barton et al. |
| 5,608,144 A | 3/1997 | Baden et al. |
| 5,608,149 A | 3/1997 | Barry et al. |
| 5,659,026 A | 8/1997 | Baszczynski et al. |
| 5,723,756 A | 3/1998 | Peferoen et al. |
| 5,737,514 A | 4/1998 | Stiffler |
| 5,747,450 A | 5/1998 | Ohba et al. |
| 5,767,373 A | 6/1998 | Ward et al. |
| 5,792,931 A | 8/1998 | Duvick et al. |
| 5,952,544 A | 9/1999 | Browse et al. |
| 5,981,722 A | 11/1999 | Chen et al. |
| 5,990,387 A | 11/1999 | Tomes et al. |
| 6,027,945 A | 2/2000 | Smith et al. |
| 6,072,050 A | 6/2000 | Bowen et al. |
| 6,121,512 A | 9/2000 | Siminszky et al. |
| 6,177,611 B1 | 1/2001 | Rice |
| 6,232,529 B1 | 5/2001 | Singletary et al. |

(Continued)

FOREIGN PATENT DOCUMENTS

| EP | 0397687 B1 | 5/1994 |
| EP | 0424047 B1 | 7/1995 |

(Continued)

OTHER PUBLICATIONS

Cao et al., A_Geneseq Database, Acc. No. ADS45204, Cao et al., US20030233675, revised Jun. 15, 2007.*
Patzoldt et al., Published Applications Database, US20100100988, SEQ ID No. 14, Apr. 22, 2010.*
Sasarman et al., Can. J. Microbiol., vol. 39, pp. 1155-1161, 1993.*
Aldemita et al., "Agrobacterium tumefaciens-mediated transformation of japonica and indica rice varieties", Planta, vol. 199, Issue 4, Aug. 1996, pp. 612-617.
Allison et al., "The nucleotide sequence of the coding region of tobacco etch virus genomic RNA: Evidence for the synthesis of a single polyprotein", Virology, vol. 154, Issue 1, Oct. 15, 1986, pp. 9-20.
Archer et al., "Current views on chloroplast protein import and hypotheses on the origin of the transport mechanism", Journal of Bioenergetics and Biomembranes, vol. 22, Issue 6, Dec. 1990, pp. 789-810.

(Continued)

*Primary Examiner* — Phuong T Bui
(74) *Attorney, Agent, or Firm* — MARSHALL, GERSTEIN & BORUN LLP

(57) ABSTRACT

The present invention refers to a recombinant chimeric nucleic acid molecule comprising a nucleic acid sequence encoding a dual transit peptide operably linked to a heterologous nucleic acid sequence encoding a polypeptide of interest which, when overexpressed in a plant, confers herbicide tolerance to said plant.

9 Claims, 28 Drawing Sheets
Specification includes a Sequence Listing.

(56) References Cited

U.S. PATENT DOCUMENTS

| | | | |
|---|---|---|---|
| 6,300,544 | B1 | 10/2001 | Halkier et al. |
| 6,368,800 | B1 | 4/2002 | Smith et al. |
| 6,380,465 | B1 | 4/2002 | Barrett |
| 6,649,814 | B2 | 11/2003 | Halkier et al. |
| 6,653,529 | B2 | 11/2003 | Peng et al. |
| 7,314,974 | B2 * | 1/2008 | Cao .............. C07K 14/195 800/289 |
| 8,097,774 | B2 | 1/2012 | Hawkes et al. |
| 2005/0060767 | A1 | 3/2005 | Subramanian et al. |
| 2005/0246798 | A1 | 11/2005 | Castle et al. |
| 2007/0004912 | A1 | 1/2007 | Castle et al. |
| 2010/0100988 | A1 | 4/2010 | Tranel et al. |
| 2010/0280345 | A1 | 11/2010 | Say et al. |
| 2013/0205441 | A1 * | 8/2013 | Lira .............. C12N 9/0071 800/278 |

FOREIGN PATENT DOCUMENTS

| | | |
|---|---|---|
| EP | 1198985 A1 | 4/2002 |
| WO | WO-91/16432 A1 | 10/1991 |
| WO | WO-93/07256 A1 | 4/1993 |
| WO | WO-93/22443 A1 | 11/1993 |
| WO | WO-94/11516 A1 | 5/1994 |
| WO | WO-95/08633 A1 | 3/1995 |
| WO | WO-98/33927 A1 | 8/1998 |
| WO | WO-99/43838 A1 | 9/1999 |
| WO | WO-02/068607 A2 | 9/2002 |
| WO | WO-02/102970 A2 | 12/2002 |
| WO | WO-2005/107437 A2 | 11/2005 |
| WO | WO-2006/024820 A1 | 3/2006 |
| WO | WO-2006/037945 A1 | 4/2006 |
| WO | WO-2006/136596 A2 | 12/2006 |
| WO | WO-2007/000077 A1 | 1/2007 |
| WO | WO-2007/071900 A1 | 6/2007 |
| WO | WO-2007/096576 A1 | 8/2007 |
| WO | WO-2008/105890 A2 | 9/2008 |
| WO | WO-2008/124495 A2 | 10/2008 |
| WO | WO-2008/141154 A2 | 11/2008 |
| WO | WO-2012/080975 A1 | 6/2012 |
| WO | WO-2013/189984 A2 | 12/2013 |
| WO | WO-2015/022636 A2 | 2/2015 |
| WO | WO-2015/022639 A2 | 2/2015 |
| WO | WO-2015/022640 A2 | 2/2015 |
| WO | WO-2015/092706 A1 | 6/2015 |
| WO | WO-2016/120116 A1 | 8/2016 |
| WO | WO-2016/203377 A1 | 12/2016 |

OTHER PUBLICATIONS

Ballas et al., "Efficient functioning of plant promoters and poly(A) sites in Xenopus oocytes", Nucleic Acids Research, vol. 17, Issue 19, Oct. 11, 1989, pp. 7891-7903.
Bevan, "Binary Agrobacterium vectors for plant transformation", Nucleic Acids Research, vol. 12, Issue 22, Nov. 26, 1984, pp. 8711-8721.
Bock, "Transgenic Plastids in Basic Research and Plant Biotechnology", Journal of Molecular Biology, vol. 312, Issue 3, Sep. 21, 2001, pp. 425-438.
Brown et al., "Lac repressor can regulate expression from a hybrid SV40 early promoter containing a lac operator in animal cells", Cell, vol. 49, Issue 5, Jun. 5, 1987, pp. 603-612.
Buchman et al., "Comparison of intron-dependent and intron-independent gene expression", Mol. Cell Biol. 8(10): 4395-405 (1988).
Callis et al., "Introns increase gene expression in cultured maize cells", Genes & Development, vol. 1, Issue 10, 1988, pp. 1183-1200.
Campbell et al., "Codon Usage in Higher Plants, Green Algae, and Cyanobacteria", Plant Physiology, vol. 92, Issue 1, Jan. 1990, pp. 1-11.
Canevascini et al., "Tissue-Specific Expression and Promoter Analysis of the Tobacco ltp1 Gene", Plant Physiology, vol. 112, Issue 2, Oct. 1996, pp. 513-524.

Castle et al., "Discovery and Directed Evolution of a Glyphosate Tolerance Gene", Science, 2004, vol. 304, pp. 1151-1154.
Chan et al., Agrobacterium-mediated production of transgenic rice plants expressing a chimeric alpha-amylase promoter/beta-glucuronidase gene, Plant Mol. Biol., 22(3):491-506 (Jun. 1993).
Chang et al., "Stable genetic transformation of *Arabidopsis thaliana* by Agrobacterium inoculation in planta", The Plant Journal, vol. 5, Issue 4, Apr. 1994, pp. 551-558.
Christensen et al., "Sequence analysis and transcriptional regulation by heat shock of polyubiquitin transcripts from maize", Plant Molecular Biology, vol. 12, Issue 6, Jun. 1989, pp. 619-632.
Christensen, et al., "Maize polyubiquitin genes: structure, thermal perturbation of expression and transcript splicing, and promoter activity following transfer to protoplasts by electroporation", Plant Molecular Biology, vol. 18, Issue 4, Feb. 1992, pp. 675-689.
Christopherson et al., "Ecdysteroid-dependent regulation of genes in mammalian cells by a *Drosophila* ecdysone receptor and chimeric transactivators", Proceedings of the National Academy of Sciences, vol. 89, Issue 14, 1992, pp. 6314-6318.
Clough et al., "Floral dip: a simplified method for Agrobacterium-mediated transformation of *Arabidopsis thaliana*", The Plant Journal, vol. 16, Issue 6, Dec. 1998, pp. 735-743.
Crossway et al., "Integration of foreign DNA following microinjection of tobacco mesophyll protoplasts", Molecular and General Genetics MGG, vol. 202, Issue 2, Feb. 1986, pp. 179-185.
Davies, et al., "Transformation of peas", Plant Cell Reports, Jan. 1993, vol. 12, Issue 3, pp. 180-183.
Dayan et al., Biochemical and structural consequences of a glycine deletion in the alpha-8 helix of protoporphyrinogen oxidase, Biochim. Biophys. Acta, 1804(7):1548-56 (Jul. 2010).
Deblaere et al., "Efficient octopine Ti plasmid-derived vectors for Agrobacterium-mediated gene transfer to plants", Nucleic Acids Research, vol. 13, Issue 13, Jul. 11, 1985, pp. 4777-4788.
Degenkolb et al., "Structural requirements of tetracycline-Tet repressor interaction: determination of equilibrium binding constants for tetracycline analogs with the Tet repressor", Antimicrobial Agents and Chemotherapy, vol. 35, Issue 8, 1991, pp. 1591-1595.
Della-Cioppa et al., "Protein Trafficking in Plant Cells", Plant Physiology, vol. 84, Issue 4, Aug. 1987, pp. 965-968.
Deuschle et al., "Regulated expression of foreign genes in mammalian cells under the control of coliphage T3 RNA polymerase and lac repressor", Proceedings of the National Academy of Sciences, vol. 86, Issue 14, 1989, pp. 5400-5404.
Deuschle et al., "RNA polymerase II transcription blocked by *Escherichia coli* lac repressor", Science, vol. 248, Issue 4954, Apr. 27, 1990, pp. 480-483.
Elroy-Stein et al., "Cap-independent translation of mRNA conferred by encephalomyocarditis virus 5' sequence improves the performance of the vaccinia virus/bacteriophage T7 hybrid expression system", Proceedings of the National Academy of Sciences, vol. 86, Issue 16, Aug. 1989, pp. 6126-6130.
Falciatore, et al., "Transformation of Nonselectable Reporter Genes in Marine Diatoms", Marine Biotechnology, vol. 1, Issue 3, May 1999, pp. 239-251.
Feldmann et al., Agrobacterium-mediated transformation of germinating seeds of *Arabidopsis thaliana*: A non-tissue culture approach, Molecular Genetics and Genomics, vol. 208, Issue 1-2, 1987, pp. 1-9.
Figge et al., "Stringent regulation of stably integrated chloramphenicol acetyl transferase genes by *E. coli* lac repressor in monkey cells", Cell, vol. 52, Issue 5, Mar. 11, 1988, pp. 713-722.
Filho et al., "Mitochondrial and chloroplast targeting sequences in tandem modify protein import specificity in plant organelles", Plant Molecular Biology, vol. 30, Issue 4, Feb. 1996, pp. 769-780.
Frame et al., "Agrobacterium tumefaciens-Mediated Transformation of Maize Embryos Using a Standard Binary Vector System", Plant physiology, vol. 129, Issue 1, 2002, pp. 13-22.
Gallie et al., "A comparison of eukaryotic viral 5'-leader sequences as enhancers of mRNA expression in vivo", Nucleic Acids Research, vol. 15, Issue 21, Nov. 11, 1987, pp. 8693-8711.
Gallie et al., "The Regulation of Gene Expression in Transformed Maize Aleurone and Endosperm Protoplasts (Analysis of Promoter

(56) References Cited

OTHER PUBLICATIONS

Activity, Intron Enhancement, and mRNA Untranslated Regions on Expression)", Plant Physiology, vol. 106, Issue 3, Nov. 1994, pp. 929-939.
Gallie et al., "The tobacco etch viral 5? leader and poly(A) tail are functionally synergistic regulators of translation", Gene, vol. 165, Issue 2, 1995, pp. 233-238.
Geiser et al., "The hypervariable region in the genes coding for entomopathogenic crystal proteins of Bacillus thuringiensis: nucleotide sequence of the kurhd1 gene of subsp. kurstaki HD1", Gene, vol. 48, Isasue 1, 1986, pp. 109-118.
Gill et al., "Negative effect of the transcriptional activator GAL4", Nature, vol. 334, 1988, pp. 721-724.
Gossen et al., "Tight control of gene expression in mammalian cells by tetracycline-responsive promoters", Proceedings of the National Academy of Sciences, vol. 89, Issue 12, 1992, pp. 5547-5551.
Guerineau, et al., "Effect of deletions in the cauliflower mosaic virus polyadenylation sequence on the choice of the polyadenylation sites in tobacco protoplasts", Molecular and General Genetics MGG, vol. 226, Issue 1-2, Apr. 1991, pp. 141-144.
Guevara-Garcia, et al., "Tissue?specific and wound?inducible pattern of expression of the mannopine synthase promoter is determined by the interaction between positive and negative cis? regulatory elements", The Plant Journal, vol. 4, Issue 3, Sep. 1993, pp. 495-505.
Hansen, et al., "Wound-inducible and organ-specific expression of ORF13 from Agrobacterium rhizogenes; 8196 T-DNA in transgenic tobacco plants", Molecular and General Genetics MGG, vol. 254, Issue 3, Apr. 1997, pp. 337-343.
Hiei, et al., "Efficient transformation of rice (*Oryza sativa* L.) mediated by Agrobacterium and sequence analysis of the boundaries of the T-DNA", The Plant Journal, vol. 6, Issue 2, Aug. 1994, pp. 271-282.
Hiltbrunner, et al., "Targeting of an abundant cytosolic form of the protein import receptor at Toc159 to the outer chloroplast membrane", Journal of Cell Biology, vol. 154, Issue 2, 2001, pp. 309-316.
Hofgen, et al., "Storage of competent cells for Agrobacterium transformation", Nucleic Acids Research, vol. 16, Issue 20, Oct. 25, 1988, p. 9877.
Hu, et al., "The inducible lac operator-repressor system is functional in mammalian cells", Cell, vol. 48, Issue 4, Feb. 27, 1987, pp. 555-566.
International Patent Application No. PCT/EP2017/062182, International Search Report and Written Opinion, dated Sep. 1, 2017.
Jackson-Constan, et al., "Molecular chaperones involved in chloroplast protein import", Biochimica et Biophysica Acta (BBA)—Molecular Cell Research, vol. 1541, Issue 1-2, Dec. 2001, pp. 102-113.
Jobling, et al., "Enhanced translation of chimaeric messenger RNAs containing a plant viral untranslated leader sequence", Nature, vol. 325, 1987, pp. 622-625.
Jones, et al., "Isolation of the tomato Cf-9 gene for resistance to Cladosporium fulvum by transposon tagging", Science, vol. 266, Issue 5186, 1994, pp. 789-793.
Joshi, "Putative polyadenylation signals in nuclear genes of higher plants: a compilation and analysis", Nucleic Acids Research, vol. 15, Issue 23, Dec. 10, 1987, pp. 9627-9640.
Jung, et al., "Dual Targeting of Myxococcus Xanthus Protoporphyrinogen Oxidase into Chloroplasts and Mitochondria and High Level Oxyfluorfen Resistance", Plant Cell and Environment, vol. 27, Issue 11, Nov. 25, 2004, pp. 1436-1446.
Katavic, et al., "In planta transformation of *Arabidopsis thaliana*", Molecular and General Genetics MGG, vol. 245, Issue 3, May 1994, pp. 363-370.
Kawamata, et al., "Temporal and Spatial Pattern of Expression of the Pea Phenylalanine Ammonia-Lyase Genel Promoter in Transgenic Tobacco", Plant and Cell Physiology, vol. 38, Issue 7, Jan. 1, 1997, pp. 792-803.

Klaus, et al., "Generation of marker-free plastid transformants using a transiently cointegrated selection gene", Nature Biotechnology, vol. 22, 2004, pp. 225-229.
Klein, et al., "High-velocity microprojectiles for delivering nucleic acids into living cells", Nature, vol. 327, 1987, pp. 70-73.
Kleinschmidt, et al., "Dynamics of repressor-operator recognition: The Tn10-encoded tetracycline resistance control", Biochemistry, vol. 27, Issue 4, 1988, pp. 1094-1104.
Koncz et al., "The promoter of TL-DNA gene 5 controls the tissue-specific expression of chimaeric genes carried by a novel type of Agrobacterium binary vector", Molecular and General Genetics MGG, vol. 204, Issue 3, Sep. 1986, pp. 383-396.
Krens, et al., "In vitro transformation of plant protoplasts with Ti-plasmid DNA", Nature, vol. 296,1982, pp. 72-74.
Labow, et al., "Conversion of the lac repressor into an allosterically regulated transcriptional activator for mammalian cells", Molecular and Cellular Biology, vol. 10, Issue 7, Jul. 1990, pp. 3343-3356.
Lam, "Analysis of Tissue-Specific Elements in the CaMV 35S Promoter", Plant Promoters and Transcription Factors, Results and Problems in Cell Differentiation book series, vol. 20, 1994, pp. 181-196.
Lamppa, "The chlorophyll a/b-binding protein inserts into the thylakoids independent of its cognate transit peptide", The Journal of Biological Chemistry, vol. 263, 1988, pp. 14996-14999.
Last, et al., "pEmu: an improved promoter for gene expression in cereal cells", Theoretical and Applied Genetics, vol. 81, Issue 5, May 1991, pp. 581-588.
Lawrence, et al., "Alterations in the Chlamydomonas Plastocyanin Transit Peptide Have Distinct Effects on in VitroImport and in Vivo Protein Accumulation", The Journal of Biological Chemistry, vol. 272, Issue 33, 1997, pp. 20357-20363.
Linsmaier, et al., "Organic Growth Factor Requirements of Tobacco Tissue Vultures", Physiologia Plantarum, vol. 18, Issue 1, Jan. 1965, pp. 100-127.
Lommel, et al., "Identification of the Maize chlorotic mottle virus capsid protein cistron and characterization of its subgenomic messenger RNA", Virology, vol. 181, Issue 1, Mar. 1991, pp. 382-385.
Macejak, et al., "Internal initiation of translation mediated by the 5? leader of a cellular mRNA", Nature, vol. 353, 1991, pp. 90-94.
Maliga, "Progress towards commercialization of plastid transformation technology", Trends in Biotechnology, vol. 21, Issue 1, Jan. 2003, pp. 20-28.
Martin, et al.,"Map-based cloning of a protein kinase gene conferring disease resistance in tomato", Science, vol. 262, Issue 5138, 1993, pp. 1432-1436.
Matringe, et al., "p-Hydroxyphenylpyruvate dioxygenase inhibitor-resistant plants", Pest Management Science, vol. 61, Issue 3, Mar. 2005, pp. 269-276.
Matsuoka, et al.,"Tissue-specific light-regulated expression directed by the promoter of a C4 gene, maize pyruvate,orthophosphate dikinase, in a C3 plant, rice", Proceedings of the National Academy of Sciences, vol. 90, Issue 20, 1993, pp. 9586-9590.
May, et al., "14-3-3 Proteins Form a Guidance Complex with Chloroplast Precursor Proteins in Plants", The Plant Cell, vol. 12, Issue 1, Jan. 2000, pp. 53-63.
McBride, et al., "Controlled expression of plastid transgenes in plants based on a nuclear DNA-encoded and plastid-targeted T7 RNA polymerase", Proceedings of the National Academy of Sciences, vol. 91 Issue 15, 1994, pp. 7301-7305.
McElroy, et al., "Isolation of an efficient actin promoter for use in rice transformation", The Plant Cell, vol. 2, Issue 2, Feb. 1990, pp. 163-171.
Mindrinos, et al., "The *A. thaliana* Disease Resistance Gene RPS2 Encodes a Protein Containing a Nucleotide-Binding Site and Leucine-Rich Repeats", Cell, vol. 78, issue 6, 1994, pp. 1089-1099.
Mishkind, et al., "Functional determinants in transit sequences: import and partial maturation by vascular plant chloroplasts of the ribulose-1,5-bisphosphate carboxylase small subunit of Chlamydomonas", Journal of Cell Biology, vol. 100, Issue 1, 1985, pp. 226-234.
Mitschke, et al., "Prediction of Dual Protein Targeting to Plant Organelles", New Phytologist, vol. 183, Issue 1, Jul. 1, 2009, pp. 224-236.

(56) References Cited

OTHER PUBLICATIONS

Mlynarova, et al., "High efficiency Agrobacterium-mediated gene transfer to flax", Plant Cell Reports, vol. 13, Issue 5, Feb. 1994, pp. 282-285.

Mogen, et al., "Upstream sequences other than AAUAAA are required for efficient messenger RNA 3'-end formation in plants", The Plant Cell, vol. 2, Issue 12, Dec. 1990, pp. 1261-1272.

Moloney, et al., "High efficiency transformation of Brassica napus using Agrobacterium vectors", Plant Cell Reports, vol. 8, Issue 4, Apr. 1989, pp. 238-242.

Munroe, et al., "Tales of poly(A): a review", Gene, vol. 91, Issue 2, Jul. 16, 1990, pp. 151-158.

Murashige, et al., "A Revised Medium for Rapid Growth and Bio Assays with Tobacco Tissue Cultures", Physiologia Plantarum, vol. 15, Issue 3, Jul. 1962, pp. 473-497.

Murray, et al., "Codon usage in plant genes", Nucleic Acids Research, vol. 17, Issue 2, Jan. 25, 1989, pp. 477-498.

Negrutiu, et al., "Hybrid genes in the analysis of transformation conditions", Plant Molecular Biology, vol. 8, Issue 5, Sep. 1987, pp. 363-373.

Oliva, et al., "Evidence that tetracycline analogs whose primary target is not the bacterial ribosome cause lysis of Escherichia coli", Antimicrobial Agents and Chemotherapy, vol. 36, Issue 5, 1992, pp. 913-919.

Orozco, et al., "Localization of light-inducible and tissue-specific regions of the spinach ribulose bisphosphate carboxylase/oxygenase (rubisco) activase promoter in transgenic tobacco plants", Plant Molecular Biology, vol. 23, Issue 6, Dec. 1993, pp. 1129-1138.

Peeters, et al., "Dual Targeting to Mitochondria and Chloroplasts", Biochimica et Biophysica Acta—Molecular Cell Research, vol. 1541, Issue 1-2, 2001, pp. 54-63.

Potrykus, "Gene Transfer to Plants: Assessment of Published Approaches and Results", Annual Review of Plant Physiology and Plant Molecular Biology, vol. 42, 1991, pp. 205-225.

Proudfoot, "Poly (A) Signals", Cell, vol. 64, Issue 4, Feb. 1991, pp. 671-674.

Qbadou, et al., The molecular chaperone Hsp90 delivers precursor proteins to the chloroplast import receptor Toc64, The EMBO Journal, vol. 25, Issue 9, May 2006, pp. 1836-1847.

Reines, et al., "Elongation factor Sil-dependent transcription by RNA polymerase II through a sequence-specific DNA-binding protein", Proceedings of the National Academy of Sciences, vol. 90, Issue 5, 1993, pp. 1917-1921.

Reznikoff, "The lactose operon?controlling elements: a complex paradigm", Molecular Microbilogy, vol. 6, Issue 17, Sep. 1992, pp. 2419-2422.

Richter, et al., "Two RpoT Genes of Physcomitrellapatens Encode Phage-Type RNA Polymerases with Dual Targeting to Mitochondria and Plastids", Gene, vol. 290, Issue 1-2, May 15, 2002, pp. 95-105.

Rinehart, et al., "Tissue-Specific and Developmental Regulation of Cotton Gene FbL2A (Demonstration of Promoter Activity in Transgenic Plants)", Plant Physiology, vol. 112, Issue 3, Nov. 1996, pp. 1331-1341.

Russell, et al., "Tissue-specific expression in transgenic maize of four endosperm promoters from maize and rice", Transgenic Research, Mar. 1997, vol. 6, Issue 2, pp. 157-168.

Sanfacon, et al., "A dissection of the cauliflower mosaic virus polyadenylation signal", Genes & Development, 1991, vol. 5, pp. 141-149.

Schmidt, et al., "A novel operon organization involving the genes for chorismate synthase (aromatic biosynthesis pathway) and ribosomal GTPase center proteins (L11, L1, L10, L12: rpIKAJL) in cyanobacterium Synechocystis PCC 6803", The Journal of Biological Chemistry, vol. 268, Issue 36, 1993, pp. 27447-27457.

Schnell, et al., "Signal peptide analogs derived from two chloroplast precursors interact with the signal recognition system of the chloroplast envelope", The Journal of Biological Chemistry, vol. 266, Issue 5, 1991, pp. 3335-3342.

Schubert, et al., "Cloning of the Alcaligenes eutrophus genes for synthesis of poly-beta-hydroxybutyric acid (PHB) and synthesis of PHB in Escherichia coli", ?Journal of Bacteriology, vol. 170, Issue 12, 1988, pp. 5837-5847.

Shillito, et al., "High Efficiency Direct Gene Transfer to Plants", Bio/Technology, vol. 3, 1985, pp. 1099-1103.

Siminszky, "Plant cytochrome P450-mediated herbicide metabolism", Phytochemistry Reviews, vol. 5, Issue 2-3, Jun. 2006, pp. 445-458.

Skuzeski et al., "Analysis of leaky viral translation termination codons in vivo by transient expression of improved B-glucuronidase vectors", Plant Molecular Biology, vol. 15, Issue 1, Jul. 1990, pp. 65-79.

Sohrt, et al., "Toc64, a New Component of the Protein Translocon of Chloroplasts", Journal of Cell Biology, vol. 148, Issue 6, 2000, pp. 1213-1221.

Staub, et al., "Accumulation of D1 polypeptide in tobacco plastids is regulated via the untranslated region of the psbA mRNA", The EMBO Journal, vol. 12, Issue 2, Feb. 1993, pp. 601-606.

Strepp, et al., "Plant nuclear gene knockout reveals a role in plastid division for the homolog of the bacterial; cell division protein FtsZ, an ancestral tubulin", Proceedings of the National Academy of Sciences, vol. 95,; Issue 8, 1998, pp. 4368-4373.

Svab, et al., "Stable transformation of plastids in higher plants", Proceedings of the National Academy of Sciences, vol. 87, Issue 21, 1990, pp. 8526-8530.

Svab, et al., "High-frequency plastid transformation in tobacco by selection for a chimeric aadA gene", Proceedings of the National Academy of Sciences, vol. 90, Issue 3, 1993, pp. 913-917.

Thomas, et al., "Site-directed mutagenesis by gene targeting in mouse embryo-derived stem cells", Cell, vol. 51, Issue 3, Nov. 6, 1987, pp. 503-512.

Van Camp, et al., "Tissue-Specific Activity of Two Manganese Superoxide Dismutase Promoters in Transgenic Tobacco", Plant Physiology, vol. 112, Issue 2, Oct. 1996, pp. 525-535.

Van Damme, et al., "Molecular cloning of mannose-binding lectins from Clivia miniata", Plant Molecular Biology, vol. 24, Issue 5, 1994, pp. 825-830.

Velten, et al., "Isolation of a dual plant promoter fragment from the Ti plasmid of Agrobacterium tumefaciens", The EMBO Journal, vol. 3, Issue 12, Dec. 1984, pp. 2723-2730.

Voinnet, et al., "An enhanced transient expression system in plants based an suppression of gene silencing by the p19 protein of tomato bushy stunt virus", The Plant Journal, vol. 33, Issue 5, Mar. 2003, pp. 949-956.

Wyborski, et al., "Analysis of inducers of the E.coli lac repressor system mammalian cells and whole animals", Nucleic Acids Research, vol. 19, Issue 17, Sep. 11, 1991, pp. 4647-4653.

Yamamoto, et al., "Light?responsive elements of the tobacco PSI?D gene are located both upstream and within the transcribed region", The Plant Journal, vol. 12, Issue 2, Aug. 1997, pp. 255-265.

Yamamoto, et al., "The Promoter of a Pine Photosynthetic Gene Allows Expression of a ?-Glucuronidase Reporter Gene in Transgenic Rice Plants in a Light-Independent but Tissue-Specific Manner", Plant and Cell Physiology, vol. 35, Issue 5, Jan. 1, 1994, pp. 773-778.

Yao, et al., "Drosophila ultraspiracle modulates ecdysone receptor function via heterodimer formation", Cell, vol. 71, Issue 1, Oct. 1992, pp. 63-72.

Yarranton, 'Inducible vectors for expression in mammalian cells', Current Opinion in Biotechnology, vol. 3, Issue 5, Oct. 1992, pp. 506-511.

De Block, et al., "Transformation of Brassica napus and Brassica oleracea Using Agrobacterium tumefaciens and the Expression of the bar and neo Genes in the Transgenic Plants", Plant Physiology, vol. 91, Issue 2, Oct. 1989, pp. 694-701.

Baim et al., "A chimeric mammalian transactivator based on the lac repressor that is regulated by temperature and isopropyl beta-D-thiogalactopyranoside", Proceedings of the National Academy of Sciences, vol. 88, Issue 12, pp. 5072-5076 (1991).

(56) References Cited

OTHER PUBLICATIONS

Fuerst et al., "Transfer of the inducible lac repressor/operator system from *Escherichia coli* to a vaccinia virus expression vector", Proceedings of the National Academy of Sciences, vol. 86, Issue 8, pp. 2549-2553 (1989).

Ishida, et al., "High efficiency transformation of maize (*Zea mays* L.) mediated by Agrobacterium tumefaciens", Nature Biotechnology, vol. 14, Issue 6, pp. 745-750 (1996).

Odell, et al., "Identification of DNA sequences required for activity of the cauliflower mosaic virus 35S promoter", Nature, vol. 313, pp. 810-812 (1985).

Zambretti, et al., "A mutant p53 protein is required for maintenance of the transformed phenotype in cells transformed with p53 plus ras cDNAs", Proceedings of the National Academy of Sciences, vol. 89, Issue 9, pp. 3952-3956 (1992).

Zhao, et al., "Immunological Characterization and Chloroplast Localization of the Tryptophan Biosynthetic Enzymes of the Flowering Plant *Arabidopsis thaliana*", The Journal of Biological Chemistry, vol. 270, Issue 11, pp. 6081-6087 (Mar. 1995).

Lee et al., "Transgenic Rice Plants Expressing a *Bacillus subtilis* Protoporphyrinogen Oxidase Gene are Resistant to Diphenyl Ether Herbicide Oxyfluorfen", Plant Cell Physiol, 2000, vol. 41, 743-749.

Nishimura et al., "Cloning and Identification of the hemG Gene Encoding Protoporphyrinogen Oxidase (PPO) of *Escherichia coli* K-12", DNA Research, vol. 2, Issue 4, 1995, pp. 1-8.

Non-Final Rejection in U.S. Appl. No. 15/736,423 dated Jan. 4, 2022.

\* cited by examiner

| 0 | 50 | 100 | 200 | g ai/ha saflufenacil |
| 0 | 25 | 50 | 100 | g ai/ha Trifludimoxazine |

A

B untreated   100 + 280   50 + 140   25 + 70

A

B untreated   300 + 150   150 + 75   50 + 25 untreated   300 + 1120   150 + 560   50 + 280 untreated        200          100          50

DUAL TRANSIT PEPTIDES FOR TARGETING POLYPEPTIDES

This application is a National Stage application of International Application No. PCT/EP2017/062181, filed May 19, 2017, which claims priority to European Patent Application No. 16170705.4, filed May 20, 2016.

INCORPORATION BY REFERENCE OF MATERIAL SUBMITTED ELECTRONICALLY

The Sequence Listing, which is a part of the present disclosure, is submitted concurrently with the specification as a text file. The name of the text file containing the Sequence Listing is "160193_Seqlisting.txt", which was created on Oct. 30, 2018 and is 1,330,363 bytes in size. The subject matter of the Sequence Listing is incorporated herein in its entirety by reference.

FIELD OF THE INVENTION

The present invention relates to the field of plant molecular biology, more specifically to targeting polypeptide of interest to chloroplast and/or mitochondria by employing novel dual transit peptides.

BACKGROUND OF THE INVENTION

Plant cells contain two organelles originally derived from endosymbiotic bacteria: mitochondria and plastids. Due to their endosymbiotic origin these organelles contain their own DNA, but only a few dozens of genes are actually encoded by these genomes. Many of the other genes originally present have been transferred to the nuclear genome of the host, the product of their expression being targeted back to the corresponding organelle. Although targeting of proteins to mitochondria and chloroplasts is generally highly specific, an increasing number of examples have been discovered where the same protein is imported into both organelles (Peeters and Small, Biochimica et Biophysica Acta 1541 (2001), pages 54 to 63). Amongst many other functions, these two organelles are best known for their roles in energy metabolism, notably respiration and photosynthesis. As mitochondria and chloroplasts are composed of several thousand proteins encoded in the nucleus and imported into the respective organelles, it is assumed that targeting is generally highly specific for one or the other organelle. Even though there may be some proteins that could be shared in theory by both organelles, most of the proteins have a specific function in the organelle to which they are targeted, such that mistargeting could have been counter selected as an unnecessary loss of valuable proteins, or might even be detrimental for the organelle (Peeters and Small, Biochimica et Biophysica Acta 1541 (2001), pages 54 to 63). Peeters and Small list in their review around 20 examples in eukaryotes (plants) where one gene produces products located in different parts of the cell. According to the authors, there are two basic ways in which a single gene can provide a product to both organelles. It can have 'twin' targeting sequences, represented by a mitochondrial and a chloroplast targeting sequence in tandem at the N-terminus of the protein, interspaced by alternative transcription and/or translation starts, and/or alternative exon splicing. The second way of obtaining dual targeting is to have a so-called 'ambiguous' targeting pre-sequence, that is recognized as an import signal by both mitochondria and chloroplasts.

Genes reported to have naturally encoded transit peptide sequences at their N-terminus include the chloroplast small subunit of ribulose-1,5-bisphosphate carboxylase (RuBisCo), de Castro Silva Filho et al. (1996) Plant Mol. Biol. 30: 769-780; Schnell, D. J. et al. (1991) J. Biol. Chem. 266 (5): 3335-3342; 5-(enolpyruvyl) shikimate-3-phosphate synthase (EPSPS), Archer et al. (1990) J. Bioenerg. and Biomemb. 22 (6):789-810; tryptophan synthase. Zhao, J. et al. (1995) J. Biol. Chem. 2 70 (I I): 6081-6087; plastocyanin, Lawrence et al. (1997) J. Biol. Chem. 272 (33):20357-20363; chorismate synthase, Schmidt et al. (1993) J. Biol. Chem. 268 (36):27477-27457; and the light harvesting chlorophyll a/b binding protein (LHBP), Lamppa et al. (1988) J. Biol. Chem. 263: 14996-14999. Although several transit peptides have been described, only a few have been utilized successfully in attempts to target chimeric molecules to chloroplasts and/or mitochondria in higher plants. The problem to be solved by the present invention is the precise and efficient targeting of proteins synthesized by cytoplasmic ribosomes to their appropriate intracellular locations. This is essential for transgenic higher plants where the transgene product is needed in an appropriate cellular organelle or compartment. The present invention provides novel dual transit peptides that efficiently transport a heterologous polypeptide of interest into the chloroplast and/or mitochondria of transgenic higher plants.

SUMMARY OF THE INVENTION

Accordingly, a first embodiment of the present invention relates to recombinant chimeric nucleic acid molecule comprising a nucleic acid sequence encoding a dual transit peptide operably linked to a heterologous nucleic acid sequence encoding a polypeptide of interest.

Preferably said transit peptide is from the genus *Amaranthus* or from the genus *Alopecurus*.

In another preferred embodiment, said dual transit peptide comprises the amino acid sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, or a variant or fragment thereof.

In another preferred embodiment, said heterologous polypeptide of interest is a polypeptide which, when overexpressed in a plant, confers herbicide tolerance to said plant.

In another preferred embodiment, said heterologous polypeptide of interest is from a prokaryote.

More preferably, the prokaryote is of the genus selected from the group consisting of *Escherichia*, *Rhodothermus*, *Opitutus*, *Chloroflexus*, *Acinetobacter*, and *Bacillus*.

Even more preferably, said polypeptide has PRO activity and confers tolerance to PRO-inhibiting herbicides.

In a particularly preferred embodiment, said polypeptide having PPO activity comprises the sequence of SEQ ID NO: 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 448, 449, 450, 451, 452, 453, 454, 455, 456, 457, 458, 459, 460, 461, 462, 463, 464, 465, 466, 467, 468, 511, 512, 513, 514, 515, 516, 517, 518, 519, 520, 521, 522, 523, 524, 525, 526, 527, 528, 529, 530, 531, 532, 533, 534, 535, or a variant or fragment thereof.

In an especially particularly preferred embodiment, the recombinant chimeric nucleic acid molecule of the present invention comprises a nucleic acid sequence encoding a polypeptide set forth in SEQ ID NO: 112, 113, 114, 115, 116, 117, 118, 119, 120, 121, 122, 123, 124, 125, 126, 127, 128, 129, 130, 131, 132, 133, 134, 136, 592, 593, 594, 595, 596, 597, 598, 599, 600, 601, 602, 603, 604, 605, 606, 607, 608, 609, 610, 611, 612, 613, 614, 615, 616, 617, 618, 619, 620, 621, 622, 623, or 624, or active variants and fragments thereof.

In another aspect, the present invention refers to an expression cassette comprising the nucleic acid molecule of the present invention, operably linked to a promoter which drives expression in a plant.

In another aspect, the present invention refers to a plant cell comprising the expression cassette of the present invention.

In another aspect, the present invention refers to a plant or plant part comprising a plant cell of the present invention.

In another aspect, the present invention refers to a seed derived from a plant of the present invention.

In another aspect, the present invention refers to a method for expressing a nucleic acid encoding a polypeptide of interest in a plant comprising (a) introducing into a plant cell the nucleic acid molecule of the present invention or the expression cassette of the present invention, and (b) regenerating a plant therefrom that comprises the the nucleic acid molecule of the present invention or the expression cassette of the present invention.

In another aspect, the present invention refers to a method for producing a herbicide tolerant plant comprising (a) introducing into a plant cell the nucleic acid molecule of the present invention or the expression cassette of the present invention, and (b) regenerating a plant therefrom that comprises the the nucleic acid molecule of the present invention or the expression cassette of the present invention.

In another aspect, the present invention refers to a method for controlling undesired vegetation at a plant cultivation site, the method comprising the steps of:
a) Providing at that site a herbicide tolerant plant that comprises the nucleic acid molecule of the present invention or the expression cassette of the present invention
b) Applying to that site an effective amount of a herbicide, wherein the effective amount of said herbicide does not kill or inhibit the growth of the herbicide-tolerant plant of a).

In another aspect, the present invention refers to a method for growing the plant of the present invention while controlling weeds in the vicinity of said plant, said method comprising the steps of:
a) growing said plant; and
b) applying a herbicide composition comprising a PPO-inhibiting herbicide to the plant and weeds,
wherein the herbicide normally inhibits protoporphyrinogen oxidase, at a level of the herbicide that would inhibit the growth of a corresponding wild-type plant.

In another aspect, the present invention refers to a combination useful for weed control, comprising (a) a nucleic acid molecule of the present invention, which polynucleotide is capable of being expressed in a plant to thereby provide to that plant tolerance to a PPO inhibiting herbicide; and (b) a PPO inhibiting herbicide.

In another aspect, the present invention refers to a process for preparing a combination useful for weed control comprising (a) providing a nucleic acid molecule of the present invention, which nucleic acid molecule is capable of being expressed in a plant to thereby provide to that plant tolerance to a PPO inhibiting herbicide; and (b) providing a PPO inhibiting herbicide In a preferred embodiment, said step of providing a nucleic acid molecule comprises providing a plant containing said nucleic acid molecule.

In another preferred embodiment, said step of providing a nucleic acid molecule comprises providing a seed containing the nucleic acid molecule.

Preferably, said process further comprises a step of applying the PPO inhibiting herbicide to the seed.

In another aspect, the present invention refers to the use of a combination useful for weed control, comprising (a) a nucleic acid molecule of the present invention, which nucleic acid molecule is capable of being expressed in a plant to thereby provide to that plant tolerance to a PPO inhibiting herbicide; and (b) a PPO inhibiting herbicide, to control weeds at a plant cultivation site

Pictures were taken 8 days after treatment (days after spraying). Top at bottom contain 2 wild type plants, upper 5 pots contain independent transgenic events (T1 plants, selected by confirming presence of resistance gene AHAS).

Figure 1:
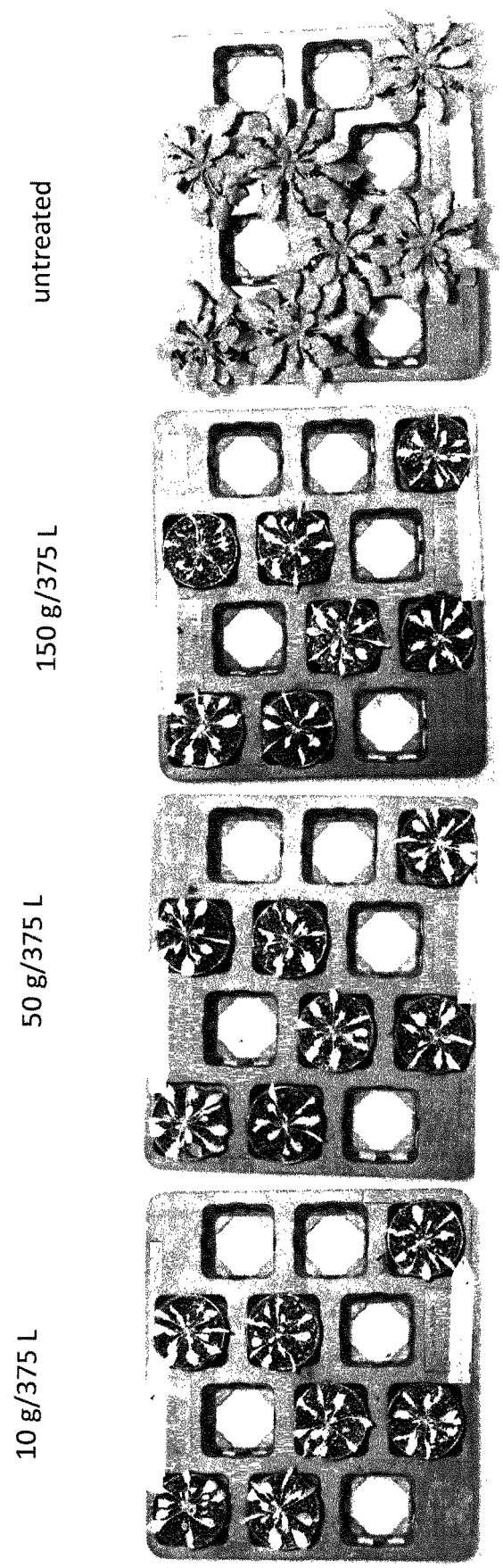
FIG. 1 shows spray of T1 *Arabidopsis* plants comprising SEQ ID NO: 113 with the indicated amounts of Saflufenacil. Pictures were taken 8 days after treatment (days after spraying). Top at bottom contain 2 wild type plants, upper 5 pots contain independent transgenic events (T1 plants, selected by confirming presence of resistance gene AHAS).
Figure 2:
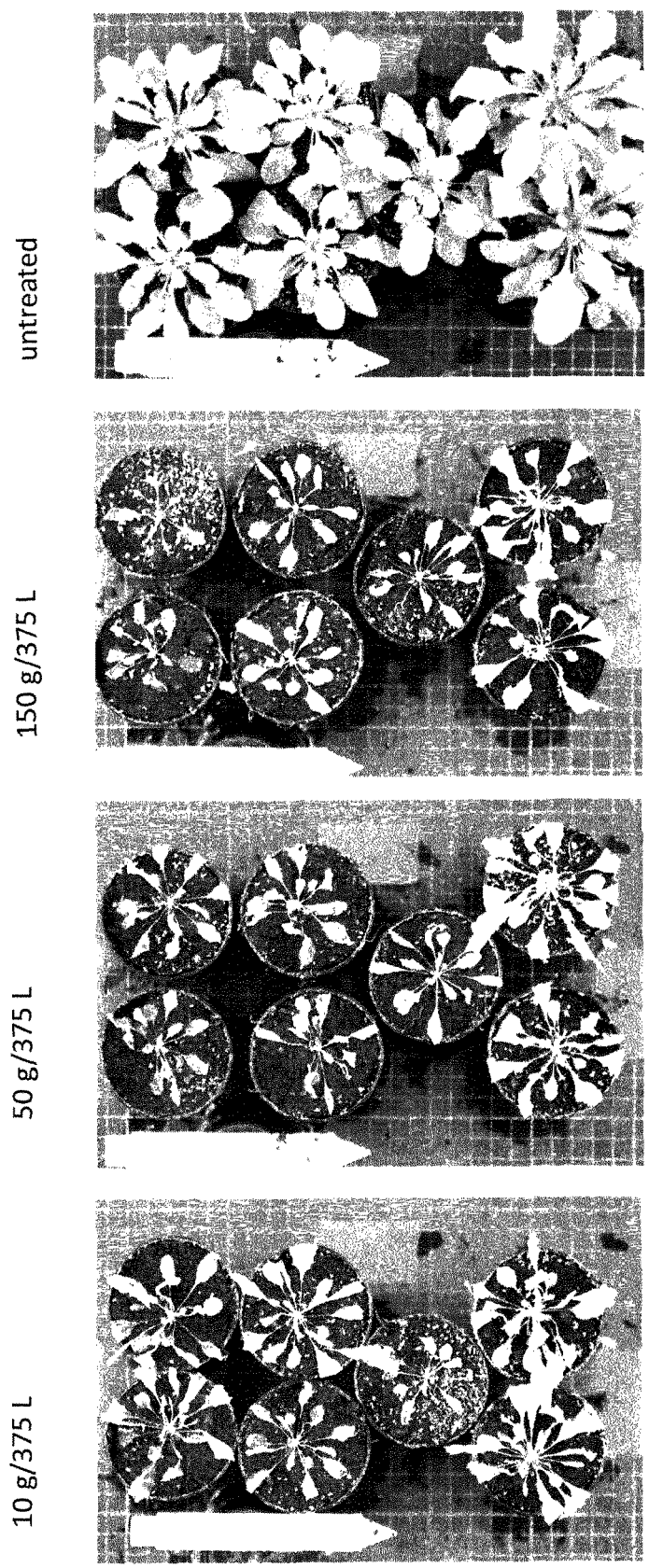
FIG. 2 shows spray of T1 *Arabidopsis* plants comprising SEQ ID NO: 114 with the indicated amounts of Saflufenacil. Pictures were taken 8 days after treatment (days after spraying). Top at bottom contain 2 wild type plants, upper 5 pots contain independent transgenic events (T1 plants, selected by confirming presence of resistance gene AHAS).
Figure 3:
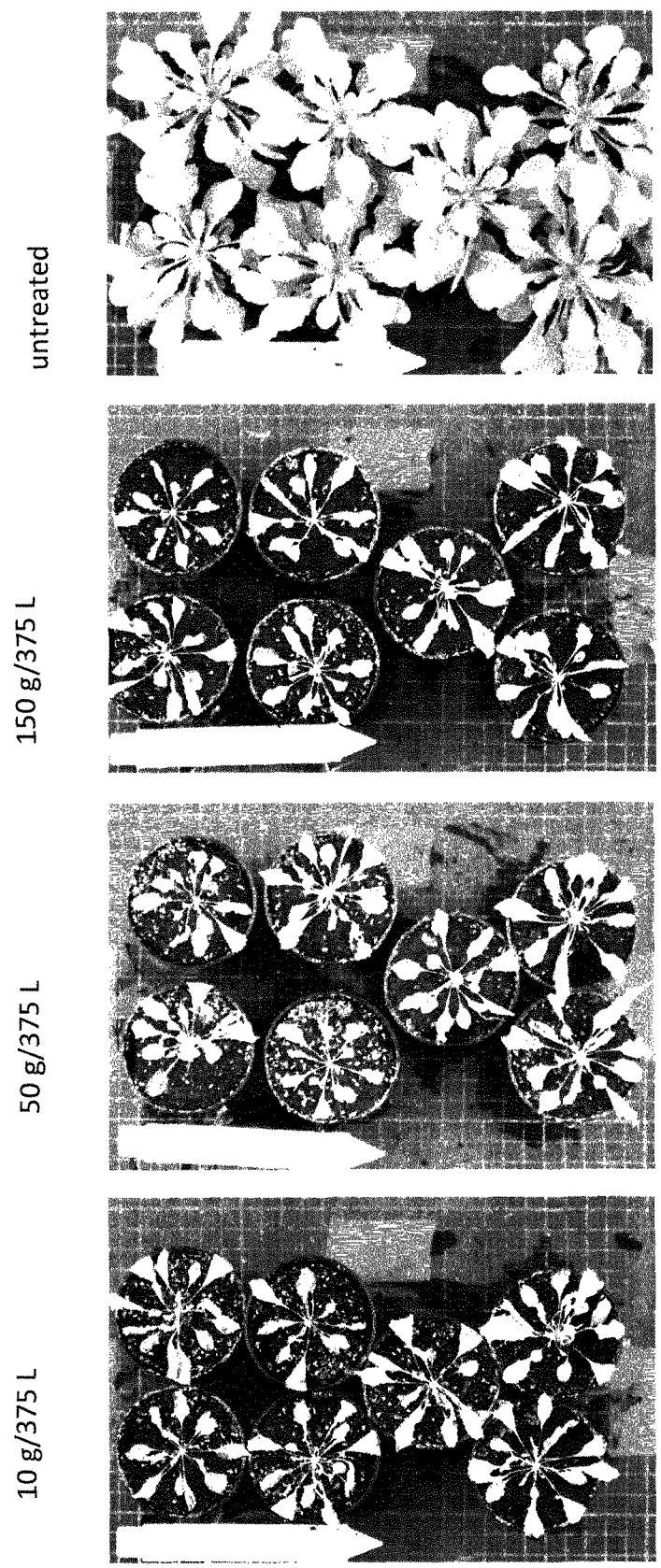
FIG. 3 shows spray of T1 *Arabidopsis* plants comprising SEQ ID NO: 115 with the indicated amounts of Saflufenacil. Pictures were taken 8 days after treatment (days after spraying). Top at bottom contain 2 wild type plants, upper 5 pots contain independent transgenic events (T1 plants, selected by confirming presence of resistance gene AHAS).
Figure 4:
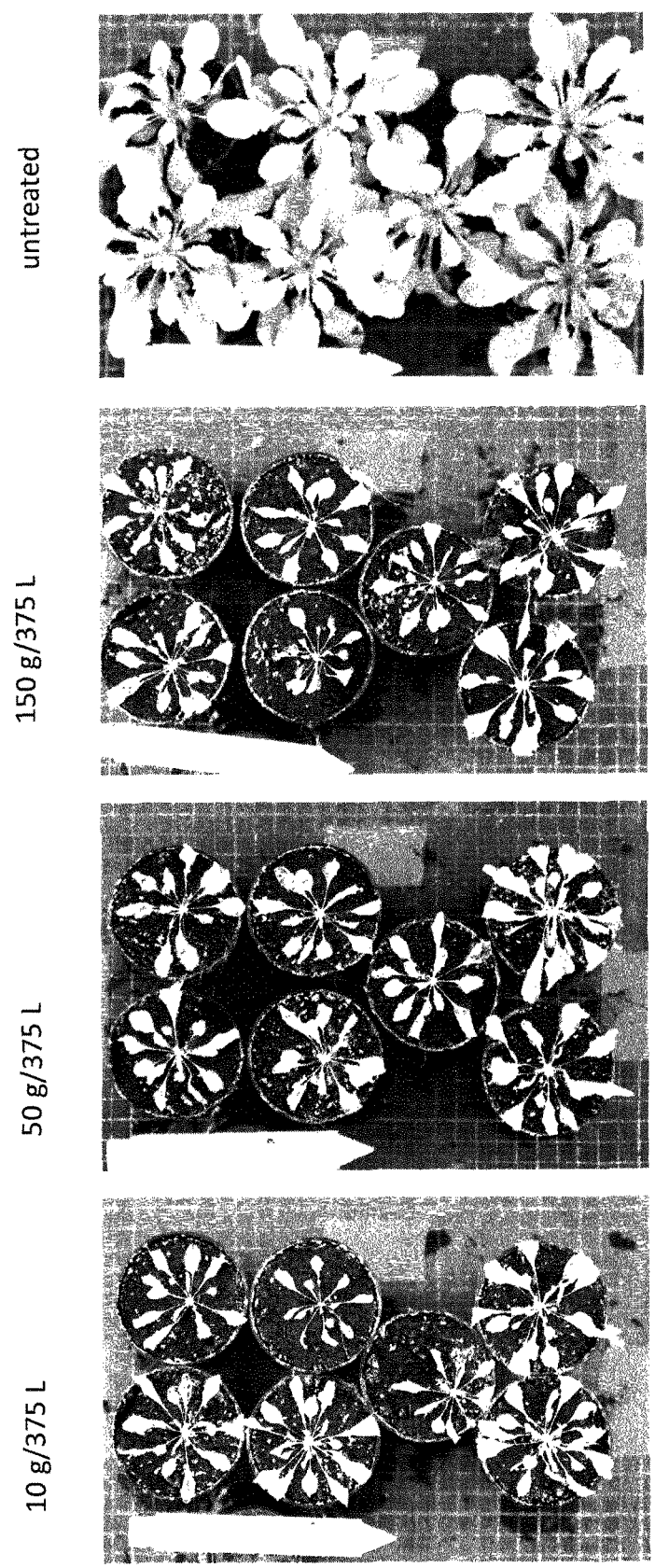
FIG. 4 shows spray of T1 *Arabidopsis* plants comprising SEQ ID NO: 116 with the indicated amounts of Saflufenacil. Pictures were taken 8 days after treatment (days after spraying). Top at bottom contain 2 wild type plants, upper 5 pots contain independent transgenic events (T1 plants, selected by confirming presence of resistance gene AHAS).
Figure 5:
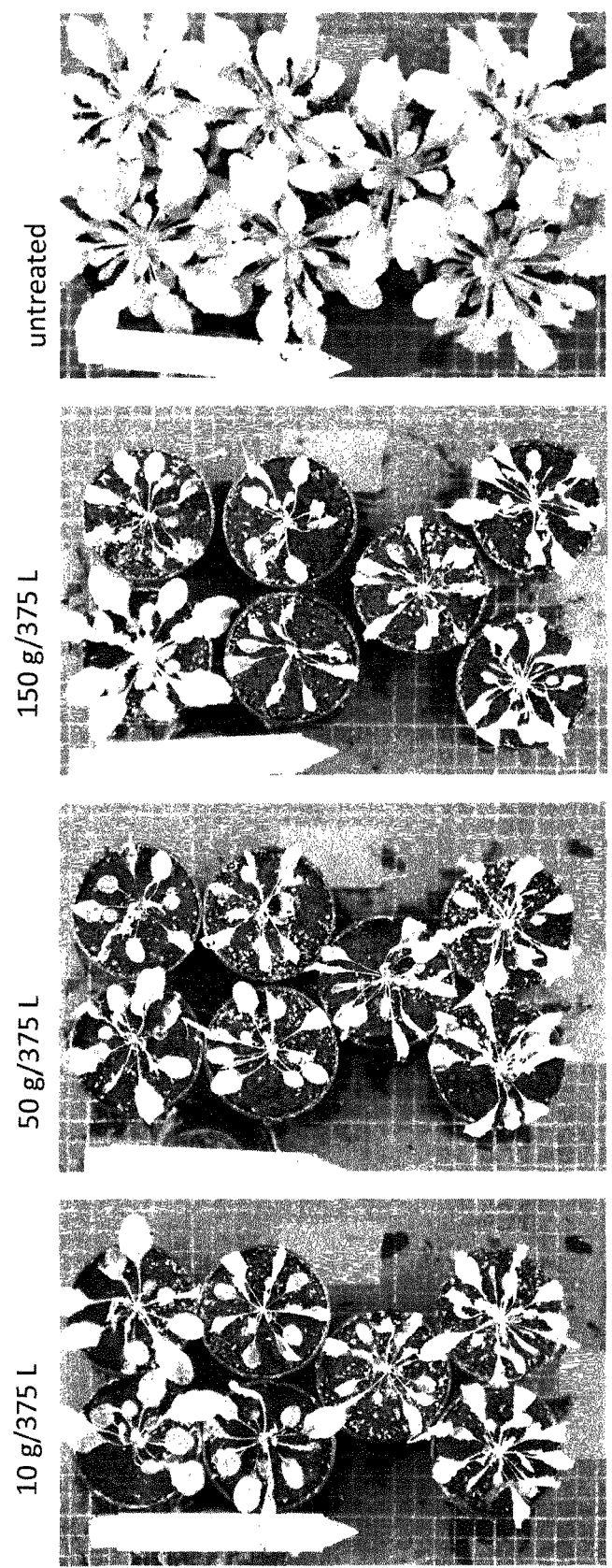
FIG. 5 shows spray of T1 *Arabidopsis* plants comprising SEQ ID NO: 117 with the indicated amounts of Saflufenacil.
Figure 6:
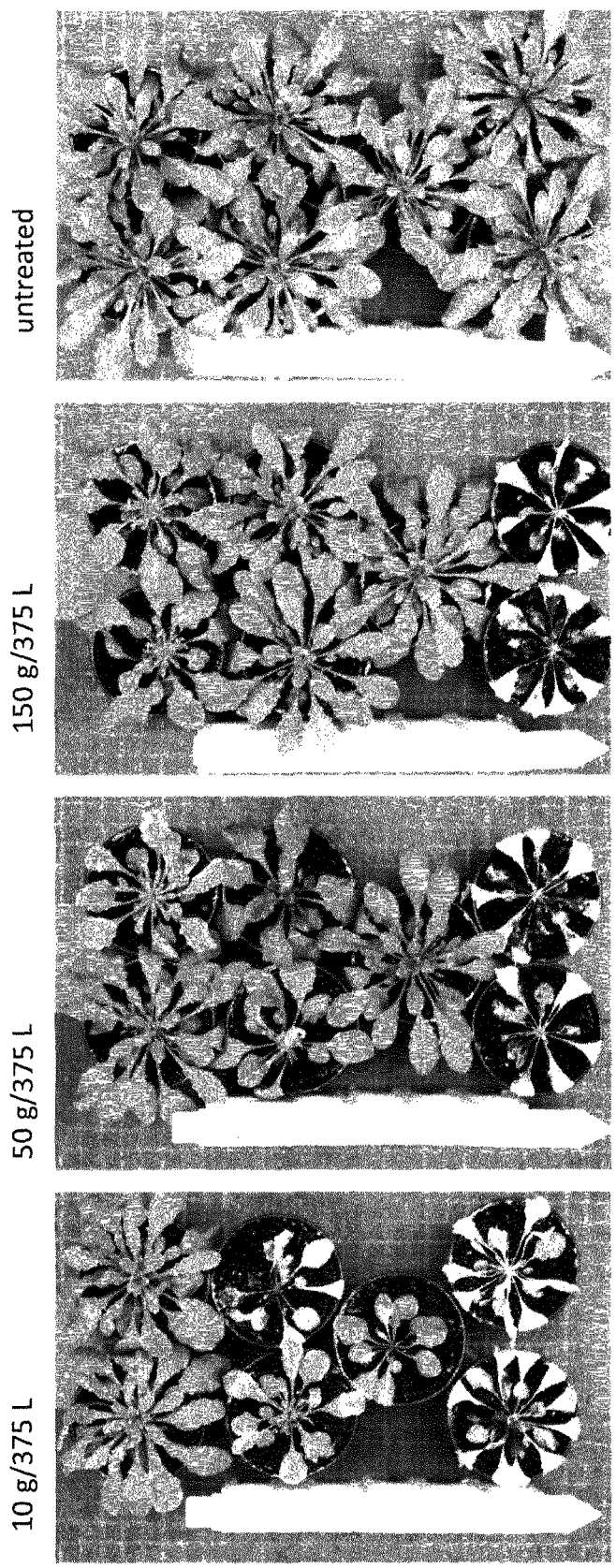

FIG. 6 shows spray of T1 *Arabidopsis* plants comprising SEQ ID NO: 118 with the indicated amounts of Saflufenacil. Pictures were taken 8 days after treatment (days after spraying). Top at bottom contain 2 wild type plants, upper 5 pots contain independent transgenic events (T1 plants, selected by confirming presence of resistance gene AHAS).

Figure 7:
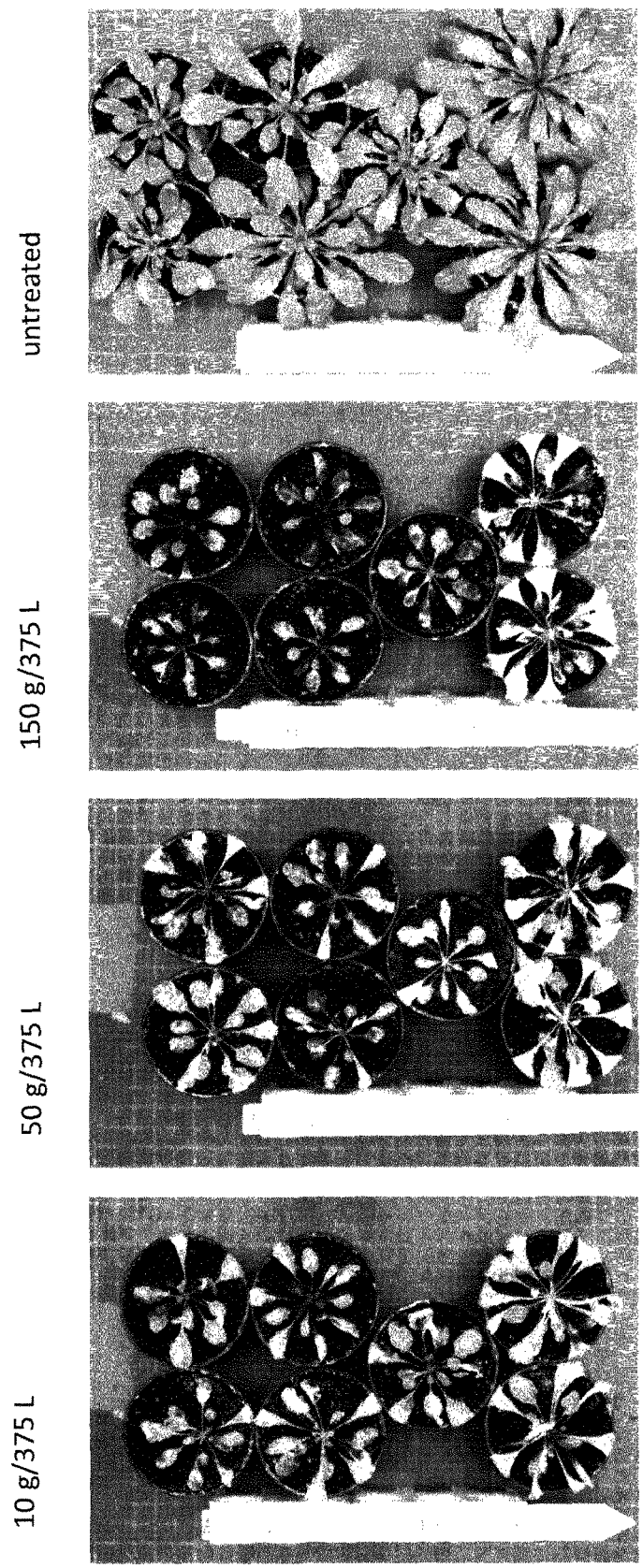

FIG. 7 shows spray of T1 *Arabidopsis* plants comprising SEQ ID NO: 119 with the indicated amounts of Saflufenacil. Pictures were taken 8 days after treatment (days after spraying). Top at bottom contain 2 wild type plants, upper 5 pots contain independent transgenic events (T1 plants, selected by confirming presence of resistance gene AHAS).

Figure 8:
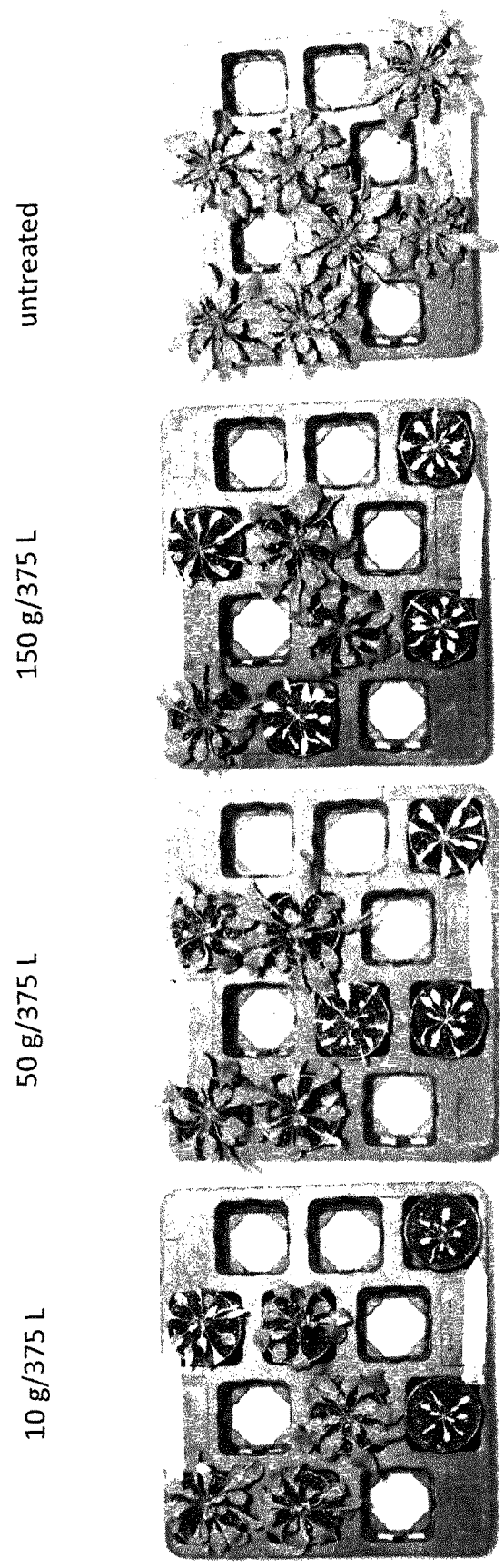

FIG. 8 shows spray of T1 *Arabidopsis* plants comprising SEQ ID NO: 120 with the indicated amounts of Saflufenacil. Pictures were taken 8 days after treatment (days after spraying). Top at bottom contain 2 wild type plants, upper 5 pots contain independent transgenic events (T1 plants, selected by confirming presence of resistance gene AHAS).

Figure 9:
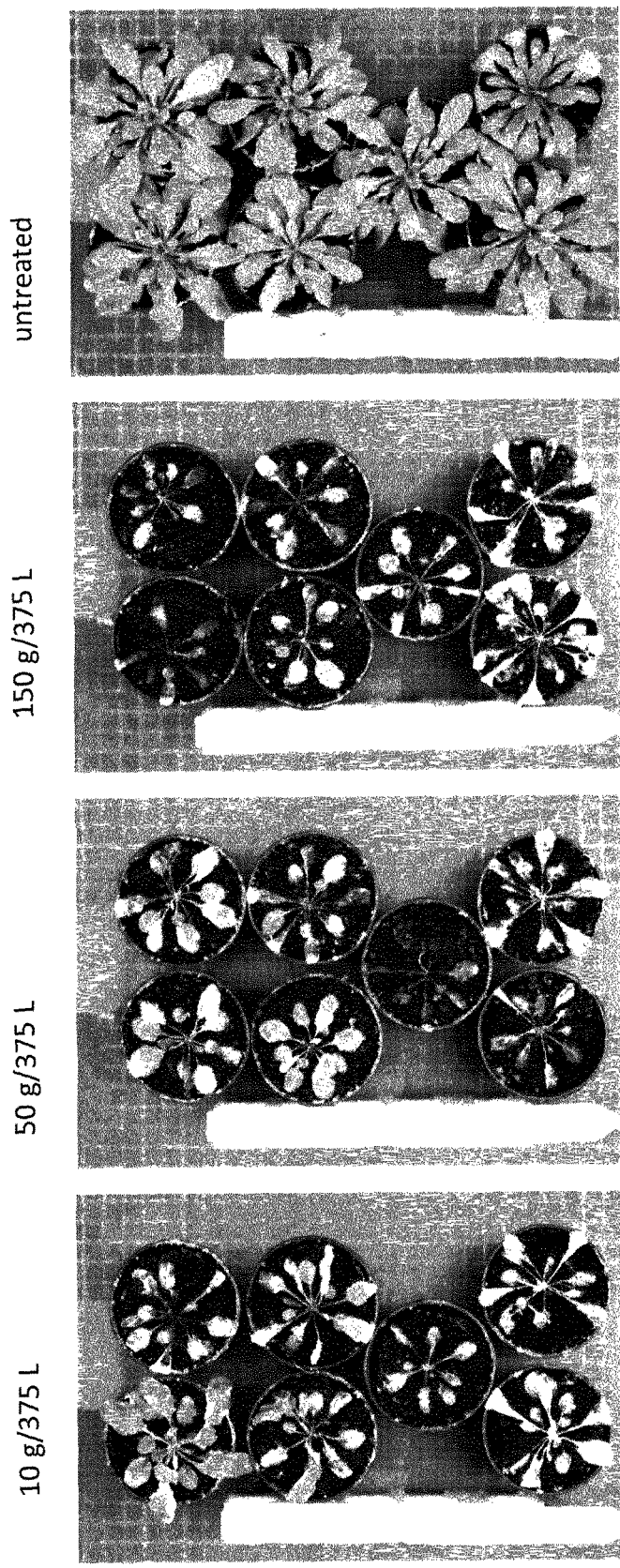

FIG. 9 shows spray of T1 *Arabidopsis* plants comprising SEQ ID NO: 121 with the indicated amounts of Saflufenacil. Pictures were taken 8 days after treatment (days after spraying). Top at bottom contain 2 wild type plants, upper 5 pots contain independent transgenic events (T1 plants, selected by confirming presence of resistance gene AHAS).

Figure 10:
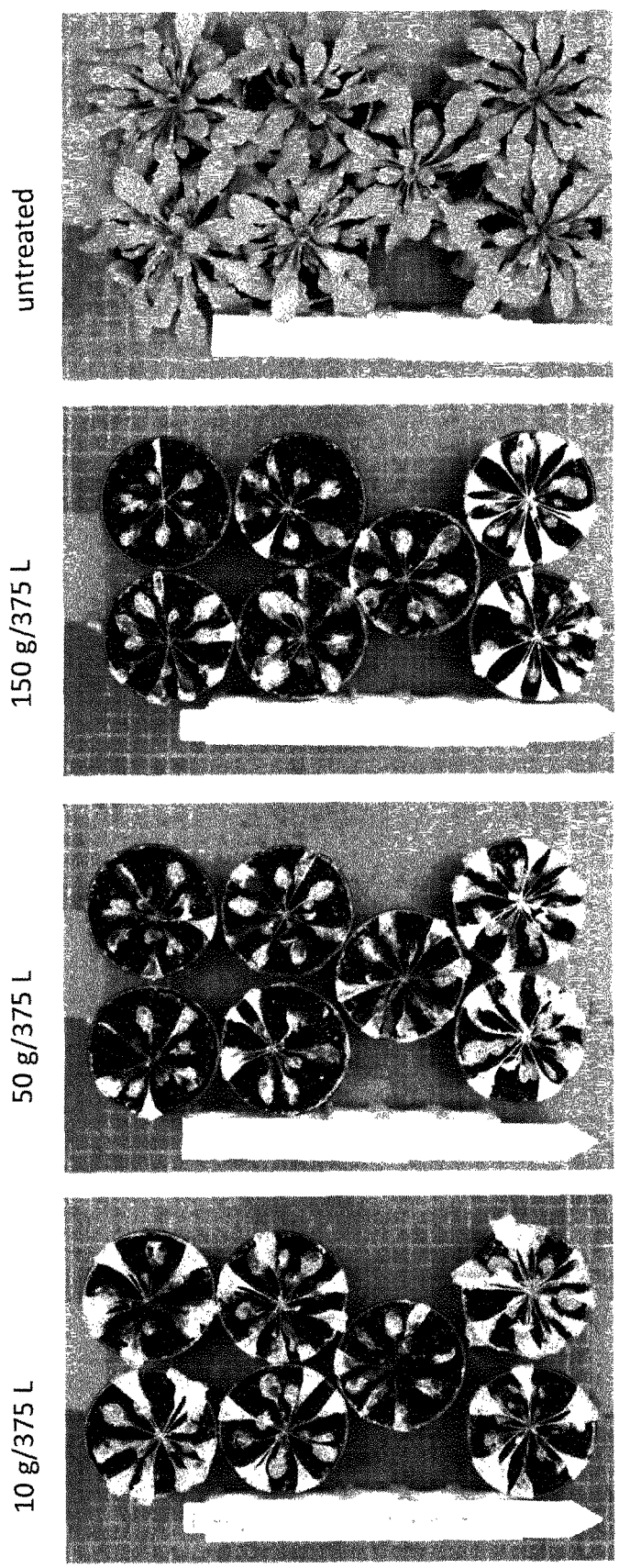

FIG. 10 shows spray of T1 *Arabidopsis* plants comprising SEQ ID NO: 123 with the indicated amounts of Saflufenacil. Pictures were taken 8 days after treatment (days after spraying). Top at bottom contain 2 wild type plants, upper 5 pots contain independent transgenic events (T1 plants, selected by confirming presence of resistance gene AHAS).

Figure 11:
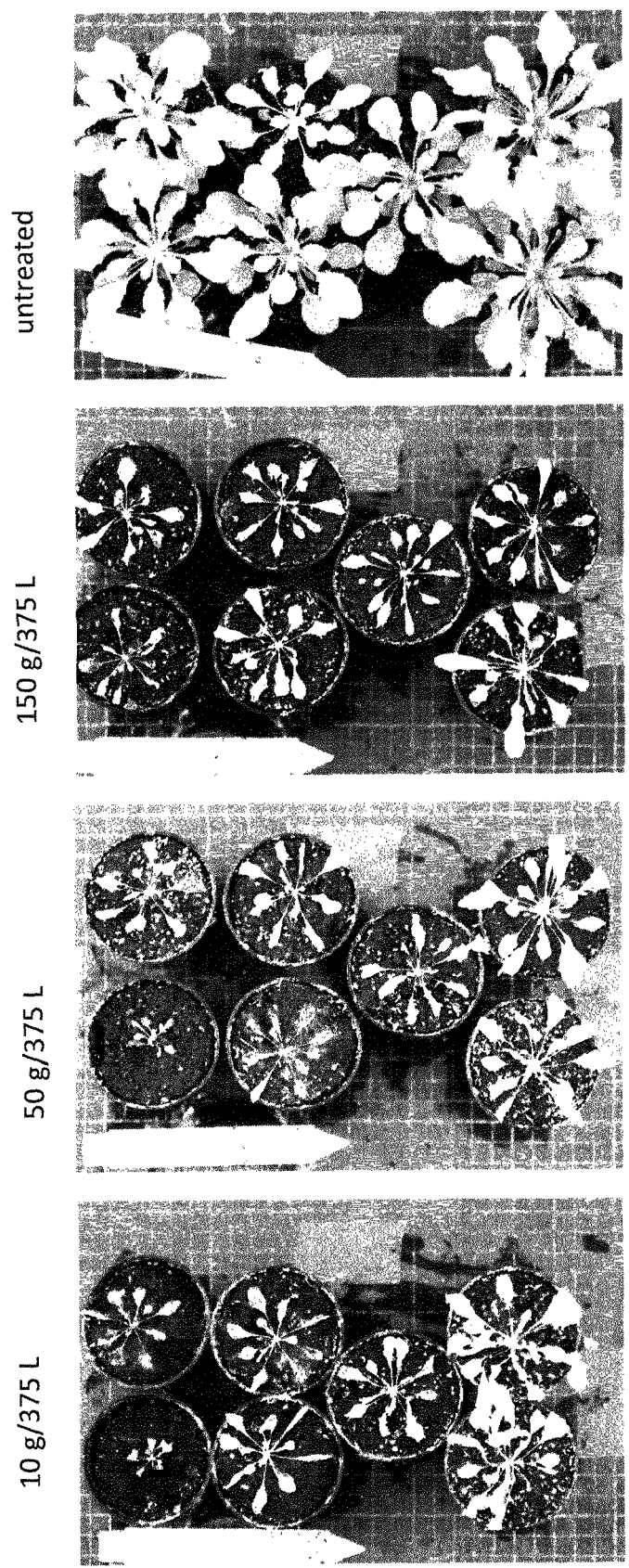

FIG. 11 shows spray of T1 *Arabidopsis* plants comprising SEQ ID NO: 127 with the indicated amounts of Saflufenacil. Pictures were taken 8 days after treatment (days after spraying). Top at bottom contain 2 wild type plants, upper 5 pots contain independent transgenic events (T1 plants, selected by confirming presence of resistance gene AHAS).

Figure 12:
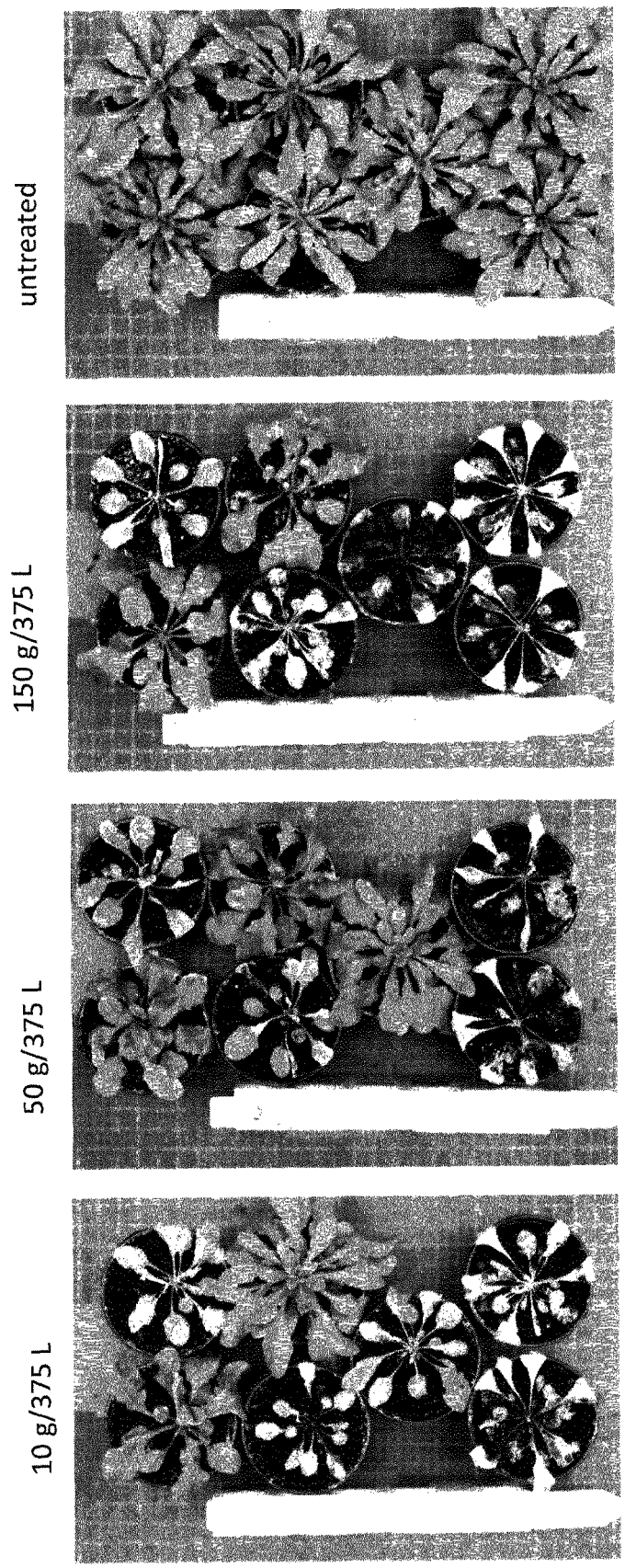

FIG. 12 shows spray of T1 *Arabidopsis* plants comprising SEQ ID NO: 128 with the indicated amounts of Saflufenacil. Pictures were taken 8 days after treatment (days after spraying). Top at bottom contain 2 wild type plants, upper 5 pots contain independent transgenic events (T1 plants, selected by confirming presence of resistance gene AHAS).

Figure 13:
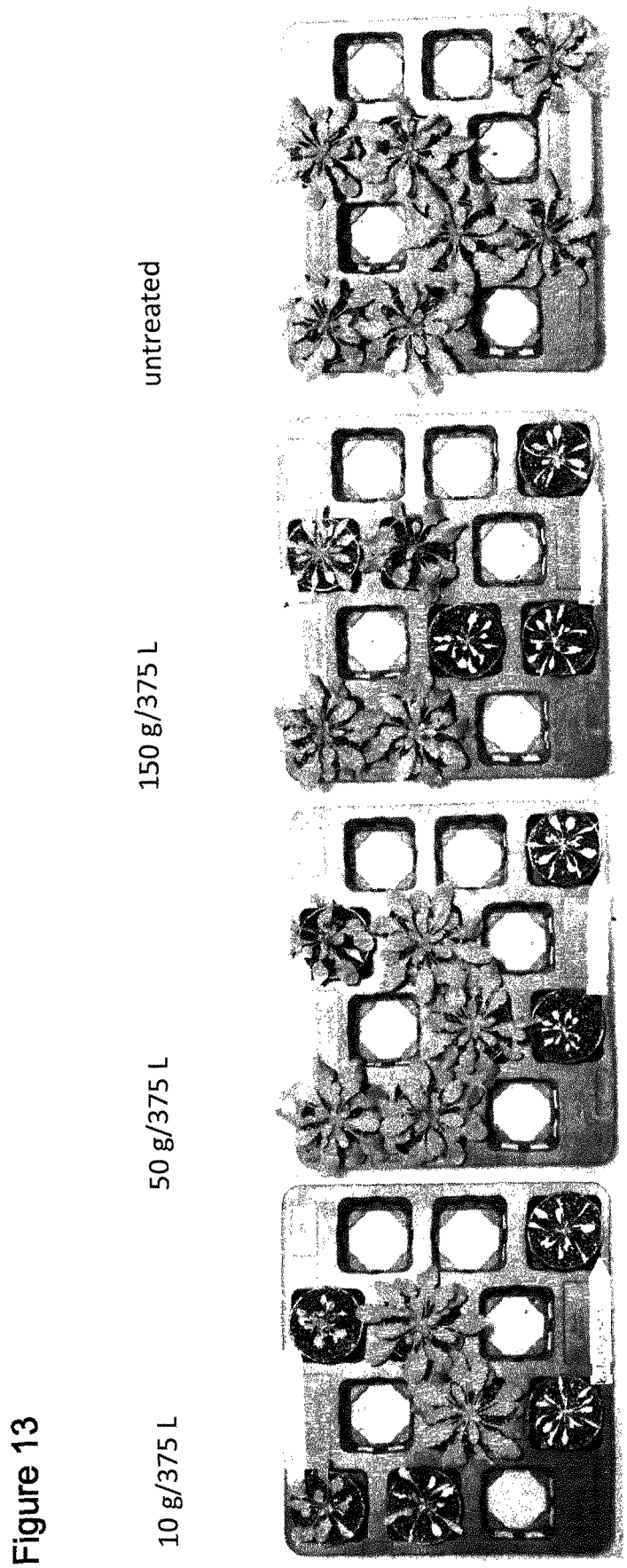

FIG. 13 shows spray of T1 *Arabidopsis* plants comprising SEQ ID NO: 130 with the indicated amounts of Saflufenacil. Pictures were taken 8 days after treatment (days after spraying). Top at bottom contain 2 wild type plants, upper 5 pots contain independent transgenic events (T1 plants, selected by confirming presence of resistance gene AHAS)

Figure 14:
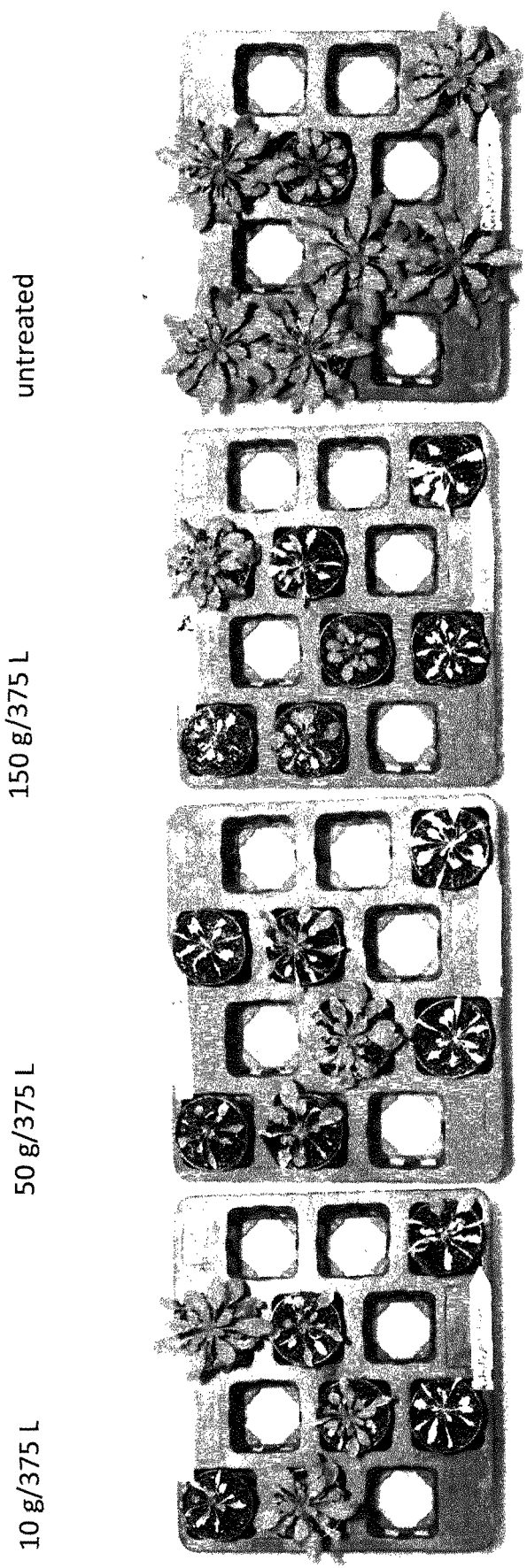

FIG. 14 shows spray of T1 *Arabidopsis* plants comprising SEQ ID NO: 133 with the indicated amounts of Saflufenacil. Pictures were taken 8 days after treatment (days after spraying). Top at bottom contain 2 wild type plants, upper 5 pots contain independent transgenic events (T1 plants, selected by confirming presence of resistance gene AHAS)

Figure 15:
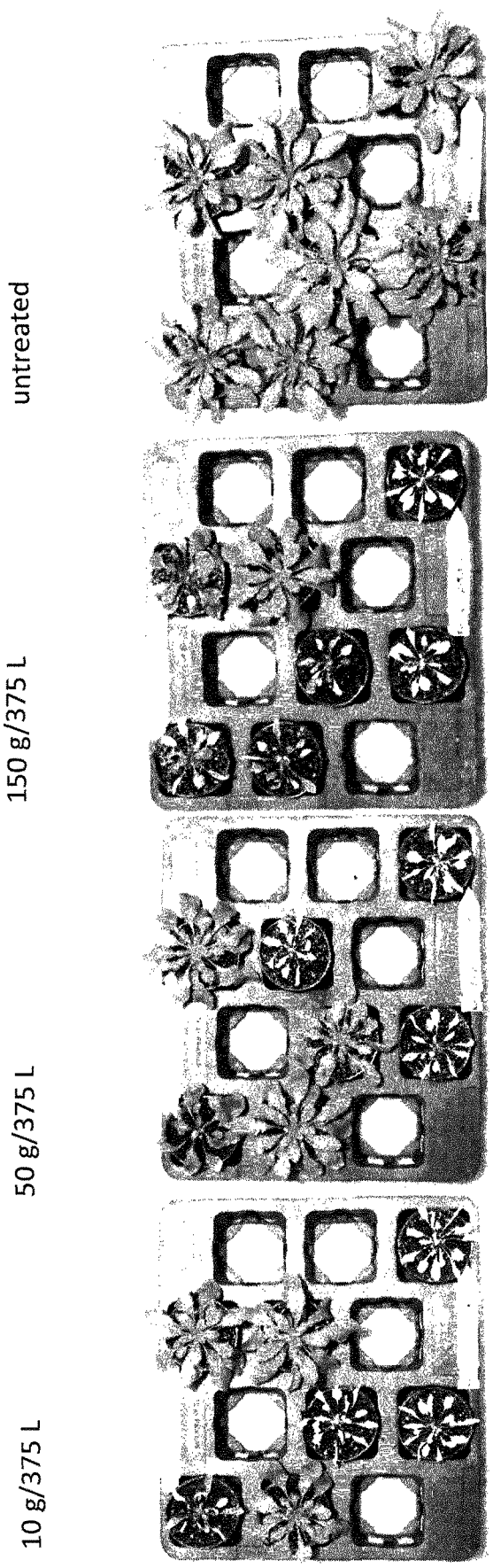

FIG. 15 shows spray of T1 *Arabidopsis* plants comprising SEQ ID NO: 134 with the indicated amounts of Saflufenacil. Pictures were taken 8 days after treatment (days after spraying). Top at bottom contain 2 wild type plants, upper 5 pots contain independent transgenic events (T1 plants, selected by confirming presence of resistance gene AHAS)

Figure 16:
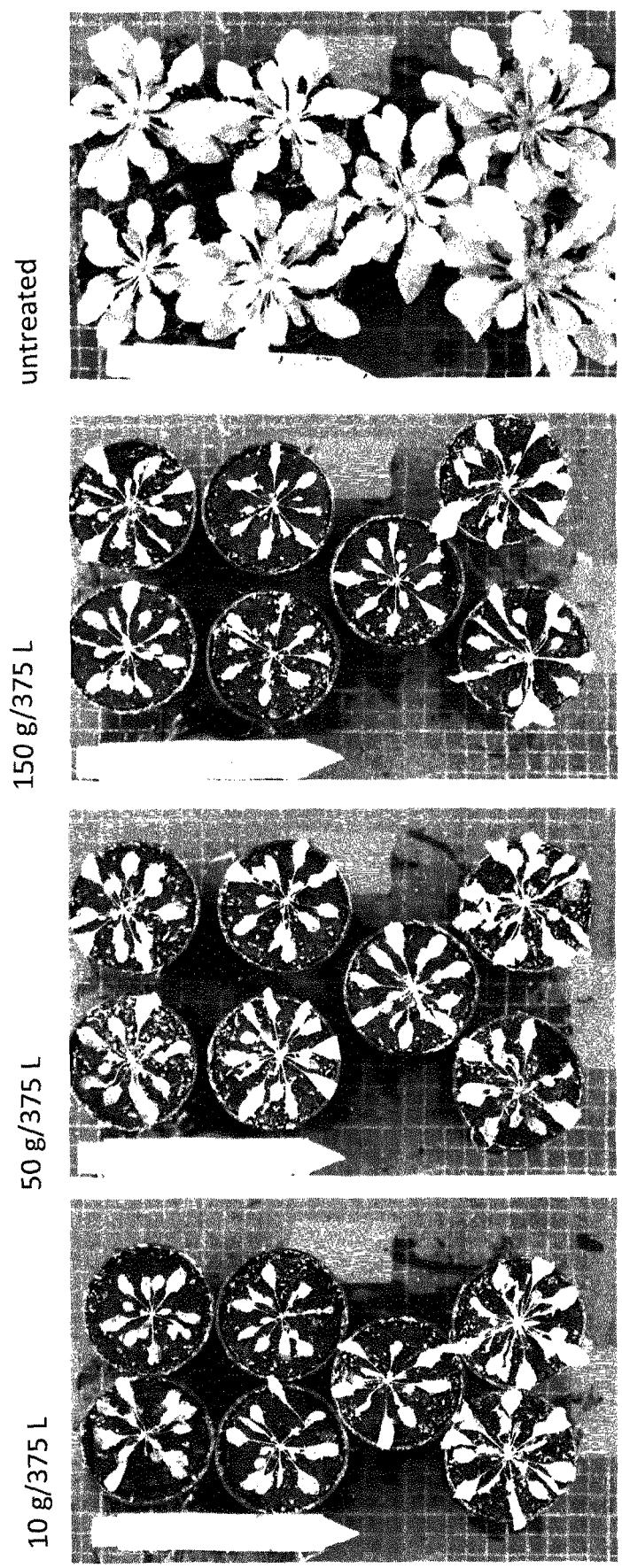

FIG. 16 shows spray of T1 *Arabidopsis* plants comprising SEQ ID NO: 126 with the indicated amounts of Saflufenacil. Pictures were taken 8 days after treatment (days after spraying). Top at bottom contain 2 wild type plants, upper 5 pots contain independent transgenic events (T1 plants, selected by confirming presence of resistance gene AHAS)

Figure 17:
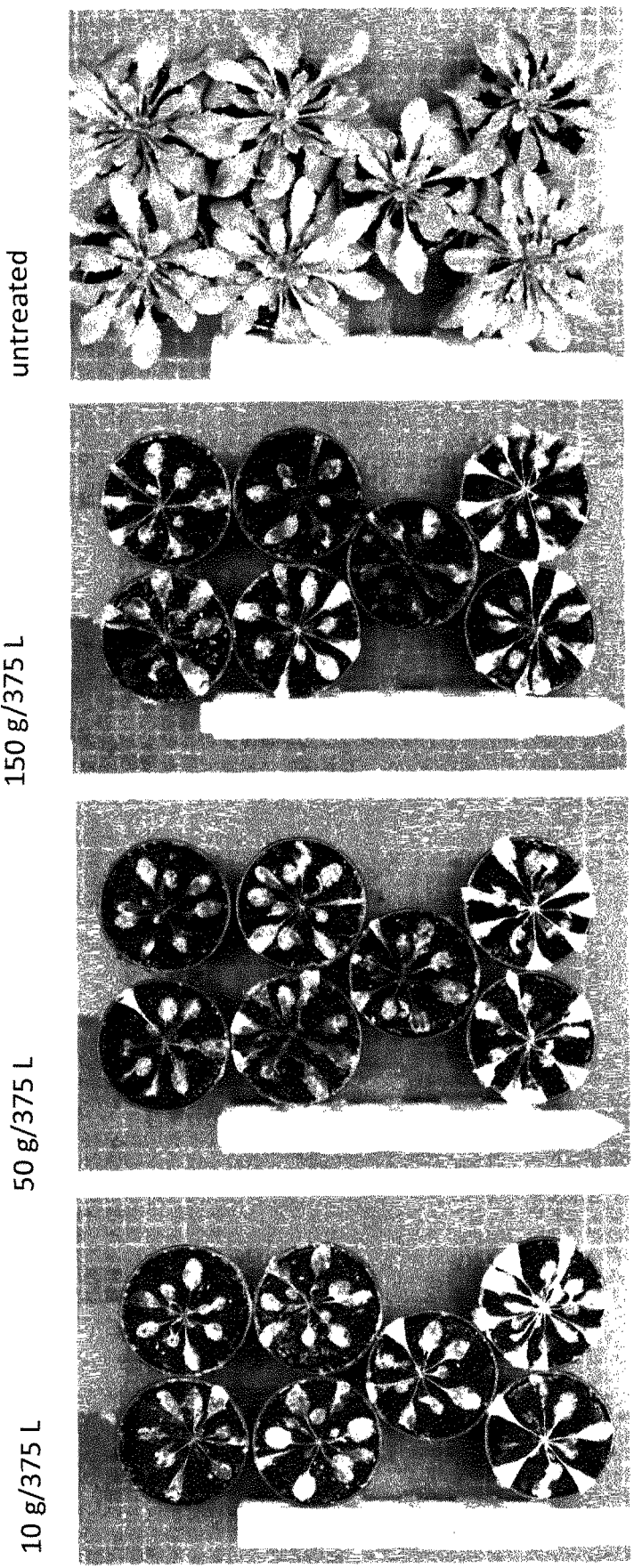

FIG. 17 shows spray of T1 *Arabidopsis* plants comprising SEQ ID NO: 124 with the indicated amounts of Saflufenacil. Pictures were taken 8 days after treatment (days after spraying). Top at bottom contain 2 wild type plants, upper 5 pots contain independent transgenic events (T1 plants, selected by confirming presence of resistance gene AHAS)

Figure 18:
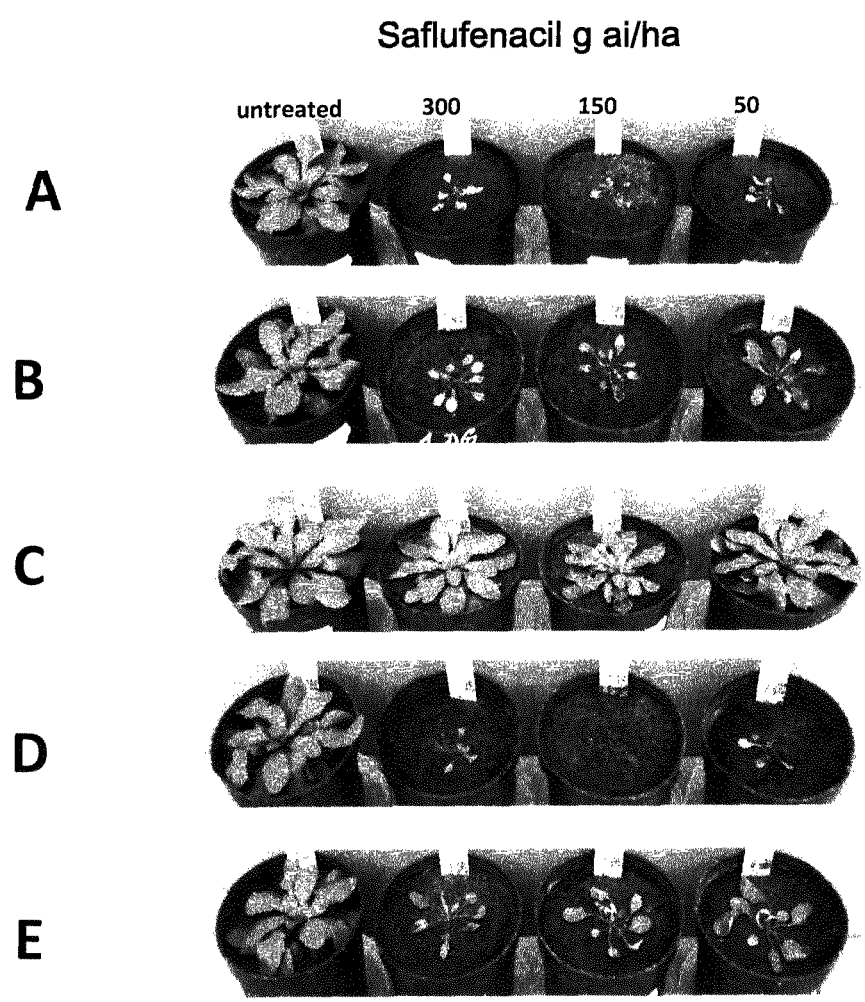
Figure 19:
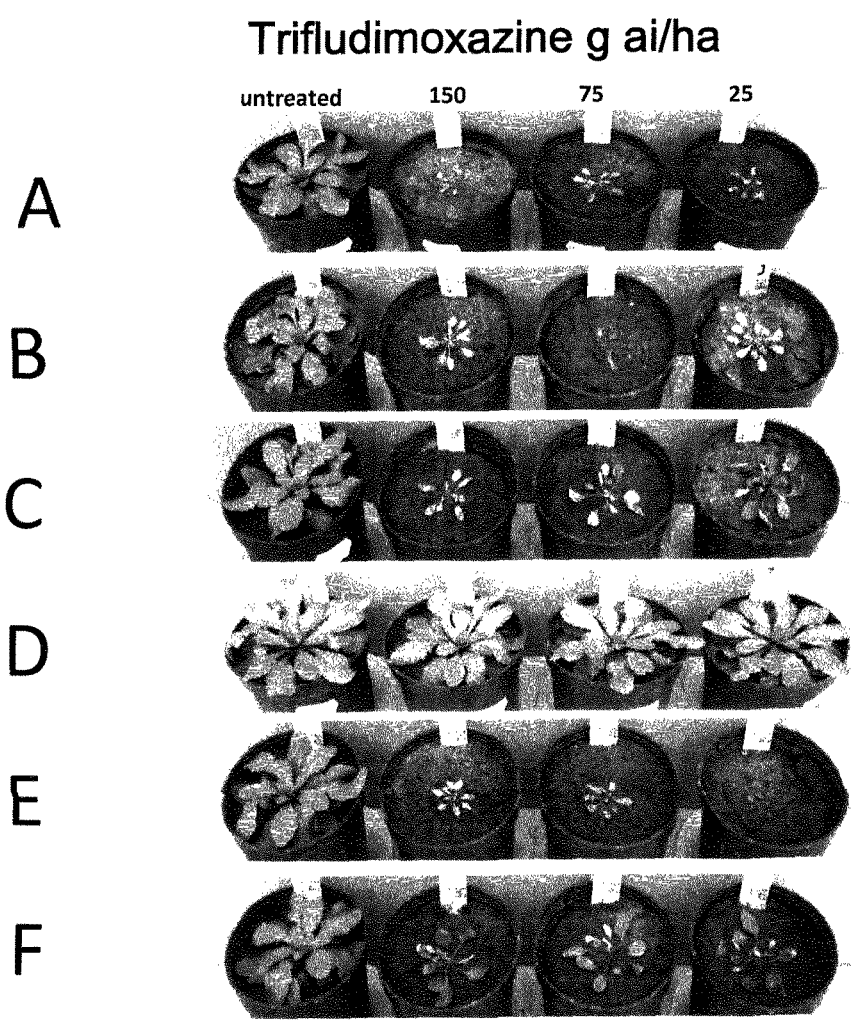

FIG. 18 shows T2 *Arabidopsis* plants treated with the indicated amounts of Saflufenacil. Panel A: untransformed control; B: transformed with a nucleic acid encoding a polypeptide comprising SEQ ID NO: 117; C: transformed with a nucleic acid encoding a polypeptide comprising SEQ ID NO: 118; D: transformed with a nucleic acid encoding a polypeptide comprising SEQ ID NO: 121; E: transformed with a nucleic acid encoding a polypeptide comprising SEQ ID NO: 128;

FIG. 19 shows T2 *Arabidopsis* plants treated with the indicated amounts of Trifludimoxazine. Panel A: untransformed control; B: transformed with a nucleic acid encoding a polypeptide comprising SEQ ID NO: 119; C: transformed with a nucleic acid encoding a polypeptide comprising SEQ ID NO: 117; D: transformed with a nucleic acid encoding a polypeptide comprising SEQ ID NO: 118; E: transformed with a nucleic acid encoding a polypeptide comprising SEQ ID NO: 121; F: transformed with a nucleic acid encoding a polypeptide comprising SEQ ID NO: 128.

Figure 20:
Figure 20:
Figure 20:
Figure 20:

FIG. 20 shows T0 Soybean cuttings treated with the indicated amounts of Saflufenacil or Trifludimoxazine. Panel A: untransformed control; B: transformed with a nucleic acid encoding a polypeptide comprising SEQ ID NO: 118 (Event 1); C: transformed with a nucleic acid encoding a polypeptide comprising SEQ ID NO: 118 (Event 2); D: transformed with a nucleic acid encoding a polypeptide comprising SEQ ID NO: 118 (Event 3).

Figure 21:
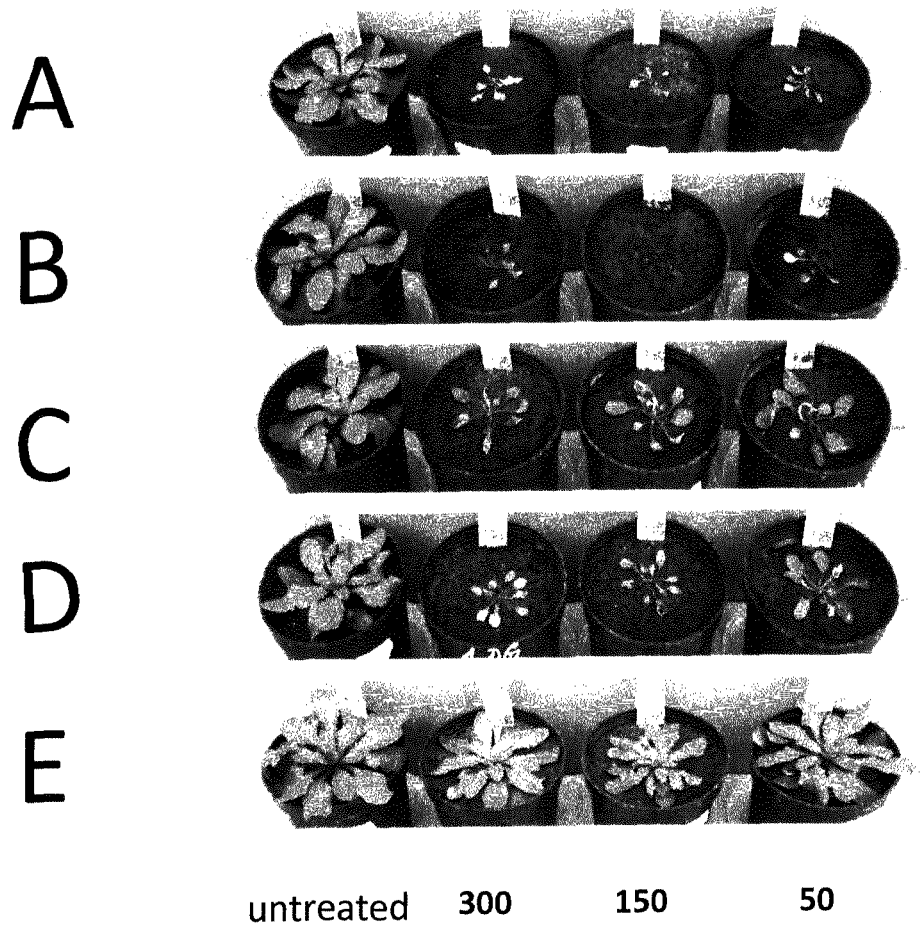
Figure 21:
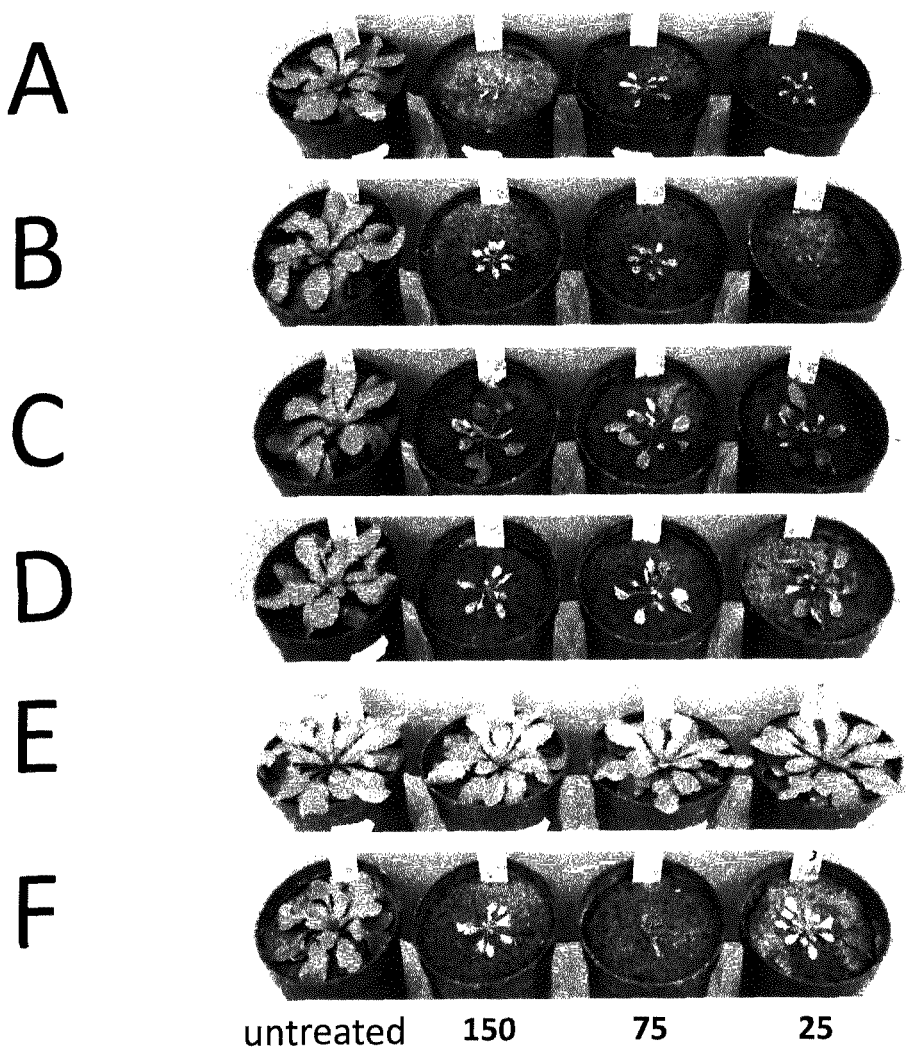
Figure 21:
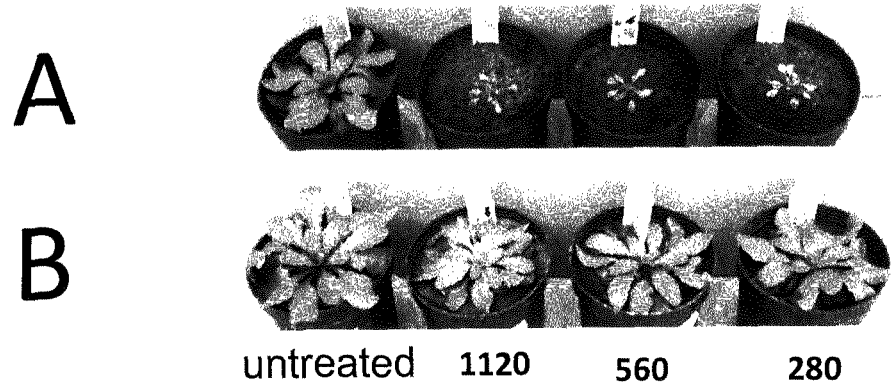
Figure 21:
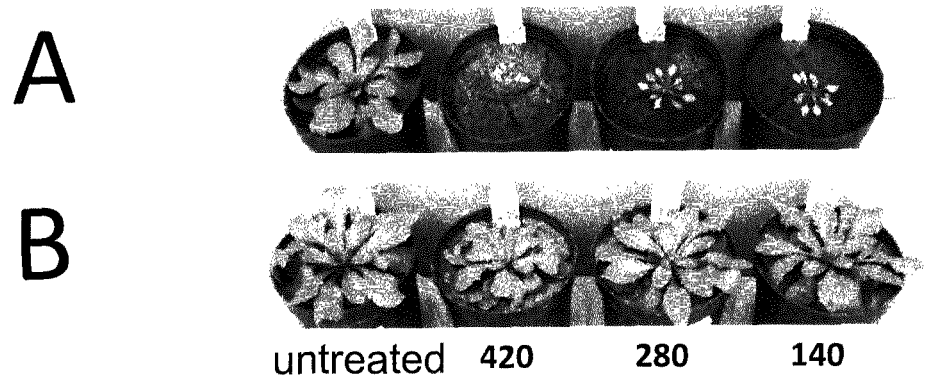
Figure 21:
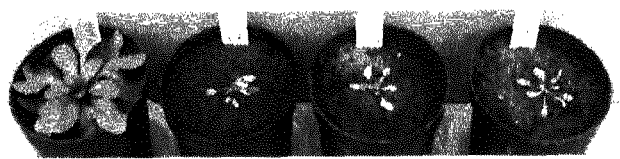
Figure 21:
Figure 21:
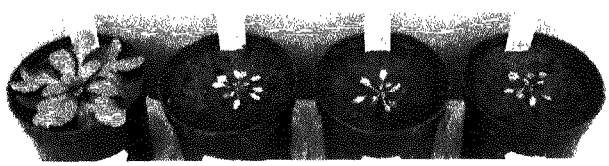
Figure 21:
Figure 21:
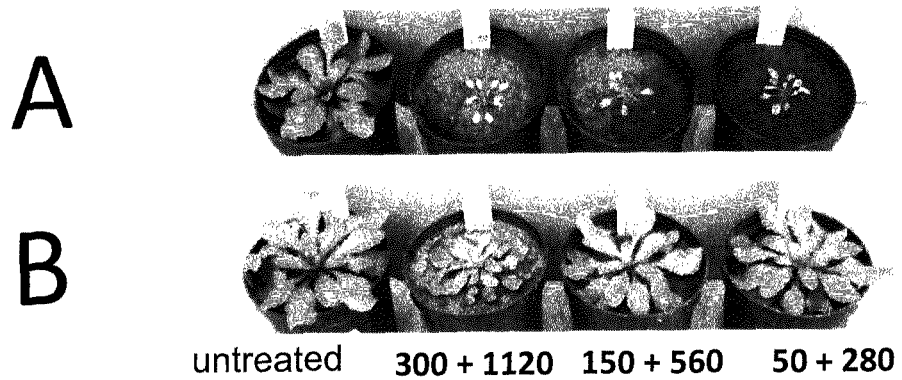
Figure 21:
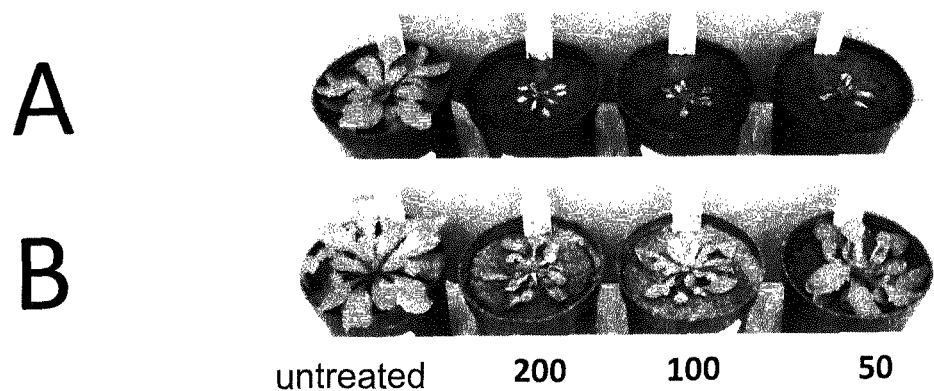

FIG. 21 A-H show non-transgenic and transgenic *Arabidopsis thaliana* treated with various PPO inhibiting herbicides. Rates indicated are in g ai/ha. Pictures taken 14 days after treatment.

21 A: Treatment with the indicated amounts g ai/ha Saflufenacil (A=wildtype/non-transgenic; B=transgene SEQ ID NO: 121; C=transgene SEQ ID NO: 128; D=Transgene SEQ ID NO: 117; E=SEQ ID NO: 118)

21 B: Treatment with the indicated amounts g ai/ha Trifludimoxazine (A=wildtype/non-transgenic; B=transgene SEQ ID NO: 121; C=transgene SEQ ID NO: 128; D=Transgene SEQ ID NO: 117; E=SEQ ID NO: 118; F=Transgene SEQ ID NO: 119)

21C: Treatment with the indicated amounts g al/ha Sulfentrazone (A=wildtype/non-transgenic; B=transgene SEQ ID NO:118)

21 D: Treatment with the indicated amounts g ai/ha Flumioxazin (A=wildtype/non-transgenic; B=transgene SEQ ID NO:118)

21 E: Treatment with the indicated mixtures g ai/ha Saflufenacil+Flumioxazin (A=wildtype/non-transgenic; B=transgene SEQ ID NO:118)

21 F: Treatment with the indicated mixtures g al/ha Saflufenacil+Trifludimoxazine (A=wildtype/non-transgenic; B=transgene SEQ ID NO:118)

21 G: Treatment with the indicated mixtures g ai/ha Saflufenacil+Sulfentrazone (A=wildtype/non-transgenic; B=transgene SEQ ID NO:118)

21 H: Treatment with the indicated amounts g ai/ha phenylpyridine (A=wildtype/non-transgenic; B=transgene SEQ ID NO:118)

Figure 22:
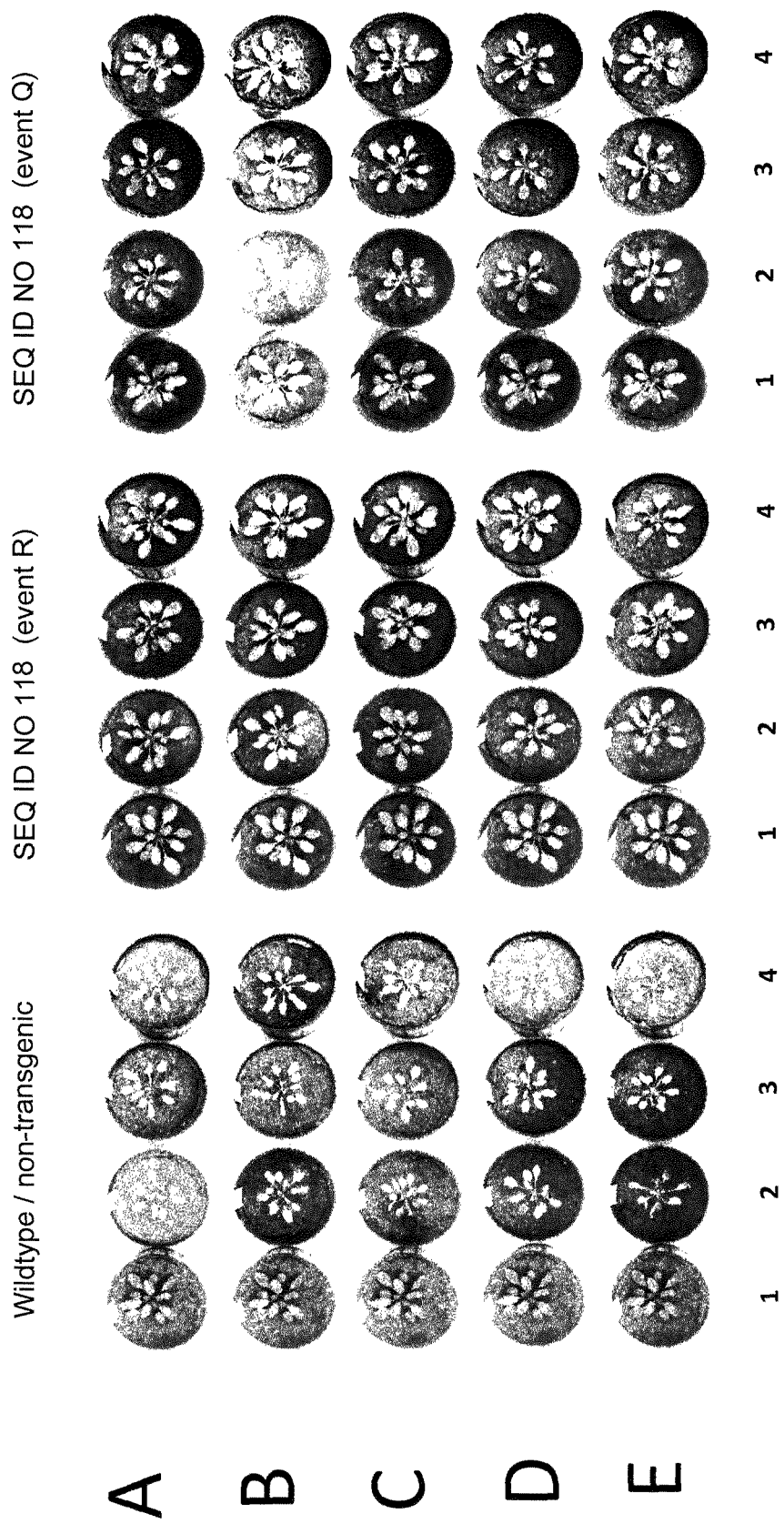

FIG. 22 shows non-transgenic and transgenic *Arabidopsis thaliana* treated with various PPO herbicides with 4 treatments (1-4). (1) is the untreated check, 2-4 are the treated plants at descending application rates (2 being the highest and (4) being the lowest. Refer to evaluation Table 4 for rates. Pictures taken 14 days after treatment (A: S3100; B: Saflufenacil; C: Trifludimoxazin; D: Saflufenacil of Trifludimoxazin; E: Flumioxazin)

Figure 23:
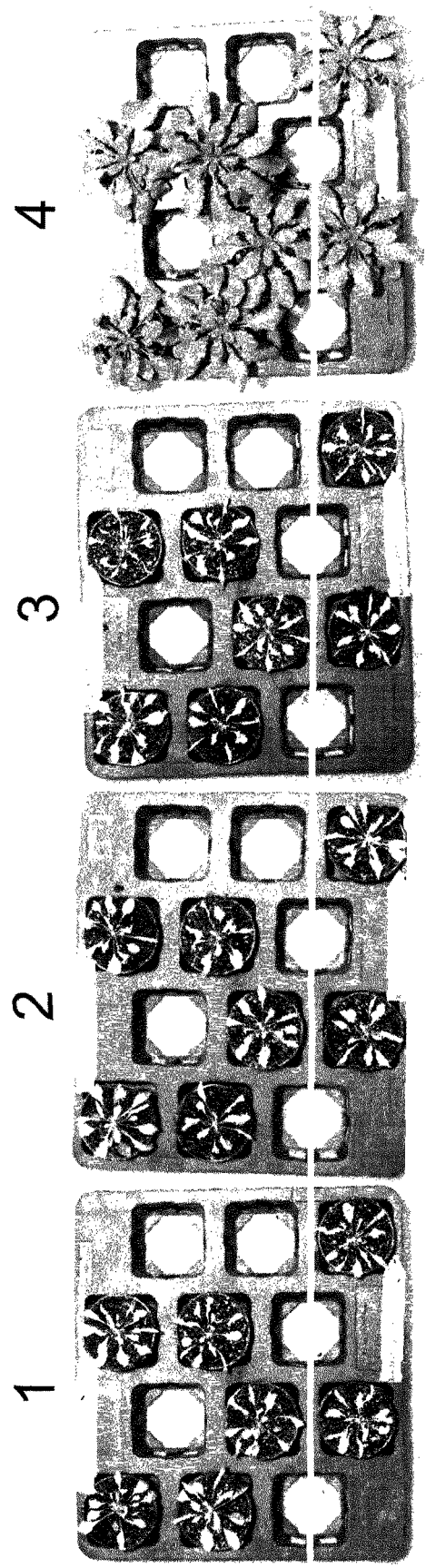
Figure 23:
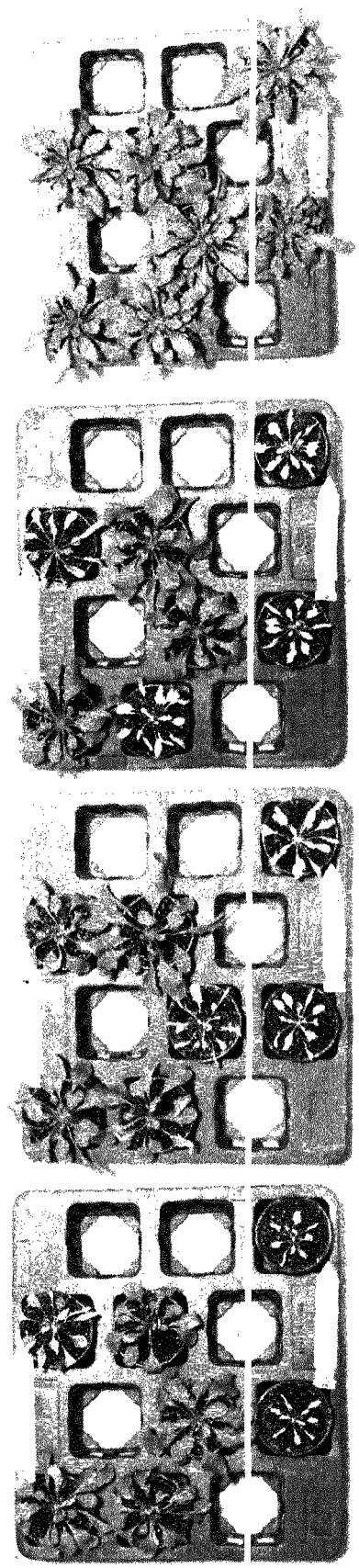
Figure 23:
Figure 23:
Figure 23:
Figure 23:
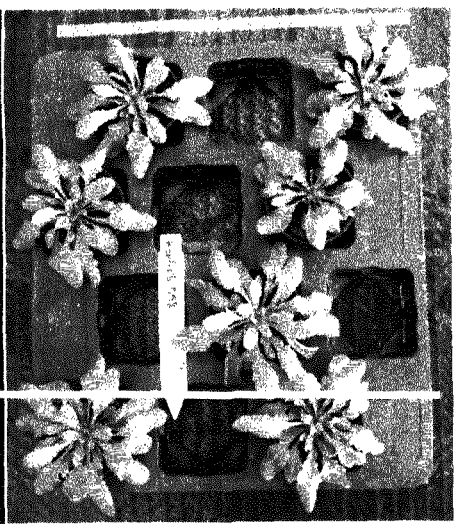

FIG. 23 shows T1 Generation PPO Herbicide Spray. Transgenic and non-transgenic *Arabidopsis thaliana* were sprayed with 10 (=1), 50 (=2) and 150 (=3) g ai/ha Saflufenacil as a post application (4=untreated). Pictures were taken 8 days after treatment (days after spraying). Upper 5 pots contain independent transgenic events, while the bottom 2 pots below the white line contain non-transgenic plants.

23 A: Transgene=SEQ ID NO: 113
23 B: Transgene=SEQ ID NO: 120
23 C: Transgene=SEQ ID NO: 129

GENERAL DEFINITIONS

It is to be understood that this invention is not limited to the particular methodology, protocols, cell lines, plant species or genera, constructs, and reagents described as such. It is also to be understood that the terminology used herein is for the purpose of describing particular embodiments only, and is not intended to limit the scope of the present invention, which will be limited only by the appended claims. It must be noted that as used herein and in the appended claims, the singular forms "a," "and," and "the" include plural reference unless the context clearly dictates otherwise. Thus, for example, reference to "a vector" is a reference to one or more vectors and includes equivalents thereof known to those skilled in the art, and so forth.

The term "about" is used herein to mean approximately, roughly, around, or in the region of. When the term "about" is used in conjunction with a numerical range, it modifies that range by extending the boundaries above and below the numerical values set forth. In general, the term "about" is used herein to modify a numerical value above and below the stated value by a variance of 20 percent, preferably 10 percent up or down (higher or lower).

As used herein, the word "or" means any one member of a particular list and also includes any combination of members of that list.

"Expression cassette" as used herein means a linear or circular nucleic acid molecule. It encompasses DNA as well as RNA sequences which are capable of directing expression of a particular nucleotide sequence in an appropriate host cell. In general, it comprises a promoter operably linked to a polynucleotide of interest, which is—optionally—operably linked to termination signals and/or other regulatory elements. The expression cassette of the present invention is characterized in that it shall comprise a transcription regulating nucleotide sequence as defined hereinafter. An expression cassette may also comprise sequences required for proper translation of the nucleotide sequence. The coding region usually codes for a protein of interest but may also code for a functional RNA of interest, for example antisense RNA or a nontranslated RNA, in the sense or antisense direction. The expression cassette comprising the polynucleotide sequence of interest may be chimeric, meaning that at least one of its components is heterologous with respect to at least one of its other components. The expression cassette may also be one, which is naturally occurring but has been obtained in a recombinant form useful for heterologous expression. An expression cassette may be assembled entirely extracellularly (e.g., by recombinant cloning techniques). However, an expression cassette may also be assembled using in part endogenous components. For example, an expression cassette may be obtained by placing (or inserting) a promoter sequence upstream of an endogenous sequence, which thereby becomes functionally linked and controlled by said promoter sequences. Likewise, a nucleic acid sequence to be expressed may be placed (or inserted) downstream of an endogenous promoter sequence thereby forming an expression cassette. The expression of the nucleotide sequence in the expression cassette may be under the control of a constitutive promoter or of an inducible promoter, which initiates transcription only when the host cell is exposed to some particular external stimulus. In the case of a multicellular organism, the promoter can also be specific to a particular tissue or organ or stage of development (e.g., the embryo preferential or embryo specific promoters of the invention). In a preferred embodiment, such expression cassettes will comprise the transcriptional initiation region of the invention linked to a nucleotide sequence of interest. Such an expression cassette is preferably provided with a plurality of restriction sites for insertion of the gene of interest to be under the transcriptional regulation of the regulatory regions. The expression cassette may additionally contain selectable marker genes. The cassette will include in the 5'-3' direction of transcription, a transcriptional and translational initiation region, a DNA sequence of interest, and a transcriptional and translational termination region functional in plants. The termination region may be native with the transcriptional initiation region, may be native with the DNA sequence of interest, or may be derived from another source. Convenient termination regions are available from the Ti-plasmid of *A. tumefaciens*, such as the octopine synthase and nopaline synthase termination regions and others described below (see also, Guerineau 1991; Proudfoot 1991; Sanfacon 1991; Mogen 1990; Munroe 1990; Belles 1989; Joshi 1987). The expression cassette can also comprise a multiple cloning site. In such a case, the multiple cloning site is, preferably, arranged in a manner as to allow for operative linkage of a polynucleotide to be introduced in the multiple cloning site with the transcription regulating sequence. In addition to the aforementioned components, the expression cassette of the present invention, preferably, could comprise components required for homologous recombination, i.e. flanking genomic sequences from a target locus. However, also contemplated is an expression cassette which essentially consists of the transcription regulating nucleotide sequence, as defined hereinafter.

"Promoter" refers to a nucleotide sequence, usually upstream (5') to its coding sequence, which controls the expression of the coding sequence by providing the recognition for RNA polymerase and other factors required for proper transcription. "Promoter" includes a minimal promoter that is a short DNA sequence comprised, in some cases, of a TATA box and other sequences that serve to specify the site of transcription initiation, to which regulatory elements are added for enhancement of expression. "Promoter" also refers to a nucleotide sequence that includes a minimal promoter plus regulatory elements and that is capable of controlling the expression of a coding sequence or functional RNA. This type of promoter sequence consists of proximal and more distal upstream elements, the latter elements often referred to as enhancers. Accordingly, an "enhancer" is a DNA sequence, which can stimulate promoter activity and may be an innate element of the promoter or a heterologous element inserted to enhance the level or tissue specificity of a promoter. It is capable of operating in both orientations (normal or flipped), and is capable of functioning even when moved either upstream or downstream from the promoter. Both enhancers and other upstream promoter elements bind sequence-specific DNA-binding proteins that mediate their effects. Promoters may be derived in their entirety from a native gene, or be composed of different elements, derived from different promoters found in nature, or even be comprised of synthetic DNA segments. A promoter may also contain DNA sequences that are involved in the binding of protein factors, which control the effectiveness of transcription initiation in response to physiological or developmental conditions. The "initiation site" is the position surrounding the first nucleotide that is part of the transcribed sequence, which is also defined as position +1. With respect to this site all other sequences of the gene and its controlling regions are numbered. Downstream sequences (i.e., further protein encoding sequences in the 3' direction) are denominated positive, while upstream sequences (mostly of the controlling regions in the 5' direction) are denominated negative. Promoter elements, such as a TATA element, that are inactive or have greatly reduced promoter activity in the absence of upstream activation are referred as "minimal" or "core" promoters. In the presence of a suitable transcription factor, the minimal promoter functions to permit transcription. A "minimal" or "core" promoter thus consists only of all basal elements needed for transcription initiation, e.g., a TATA box and/or an initiator.

"Constitutive promoter" refers to a promoter that is able to express the open reading frame (ORF) in all or nearly all of the plant tissues during all or nearly all developmental stages of the plant. Each of the transcription-activating elements do not exhibit an absolute tissue-specificity, but mediate transcriptional activation in most plant tissues at a level of at least 1% reached in the plant tissue in which transcription is most active. "Constitutive expression" refers to expression using a constitutive promoter.

"Regulated promoter" refers to promoters that direct gene expression not constitutively, but in a temporally- and/or spatially-regulated manner, and includes both tissue-specific and inducible promoters. It includes natural and synthetic sequences as well as sequences which may be a combination of synthetic and natural sequences. Different promoters may direct the expression of a gene in different tissues or cell types, or at different stages of development, or in response to different environmental conditions. New promoters of various types useful in plant cells are constantly being discovered, numerous examples may be found in the compilation by Okamuro et al. (1989). Typical regulated promoters useful in plants include but are not limited to safener-inducible promoters, promoters derived from the tetracycline-inducible system, promoters derived from salicylate-inducible systems, promoters derived from alcohol-inducible systems, promoters derived from glucocorticoid-inducible system, promoters derived from pathogen-inducible systems, and promoters derived from ecdysone-inducible systems. "Conditional" and "regulated expression" refer to expression controlled by a regulated promoter.

"Inducible promoter" refers to those regulated promoters that can be turned on in one or more cell types by an external stimulus, such as a chemical, light, hormone, stress, or a pathogen. As used herein, "transcription regulating nucleotide sequence", refers to nucleotide sequences influencing the transcription, RNA processing or stability, or translation of the associated (or functionally linked) nucleotide sequence to be transcribed. The transcription regulating nucleotide sequence may have various localizations with the respect to the nucleotide sequences to be transcribed. The transcription regulating nucleotide sequence may be located upstream (5' non-coding sequences), within, or downstream (3' non-coding sequences) of the sequence to be transcribed (e.g., a coding sequence). The transcription regulating nucleotide sequences may be selected from the group comprising enhancers, promoters, translation leader sequences, introns, 5'-untranslated sequences, 3'-untranslated sequences, and polyadenylation signal sequences. They include natural and synthetic sequences as well as sequences, which may be a combination of synthetic and natural sequences. As is noted above, the term "transcription regulating nucleotide sequence" is not limited to promoters. However, preferably a transcription regulating nucleotide sequence of the invention comprises at least one promoter sequence (e.g., a sequence localized upstream of the transcription start of a gene capable to induce transcription of the downstream sequences). In one preferred embodiment the transcription regulating nucleotide sequence of the invention comprises the promoter sequence of the corresponding gene and—optionally and preferably—the native 5'-untranslated region of said gene. Furthermore, the 3'-untranslated region and/or the polyadenylation region of said gene may also be employed.

As used herein, the term "cis-regulatory element" or "promoter motif" refers to a cis-acting transcriptional regulatory element that confers an aspect of the overall control of gene expression. A cis-element may function to bind transcription factors, trans-acting protein factors that regulate transcription. Some cis-elements bind more than one transcription factor, and transcription factors may interact in different affinities with more than one cis-element. The promoters of the present invention desirably contain cis-elements that can confer or modulate gene expression. Cis-elements can be identified by a number of techniques, including deletion analysis, i.e., deleting one or more nucleotides from the 5' end or internal of a promoter; DNA binding protein analysis using DNase I footprinting, methylation interference, electrophoresis mobility-shift assays, in vivo genomic footprinting by ligation-mediated PCR, and other conventional assays; or by DNA sequence similarity analysis with known cis-element motifs by conventional DNA sequence comparison methods. The fine structure of a cis-element can be further studied by mutagenesis (or substitution) of one or more nucleotides or by other conventional methods. Cis-elements can be obtained by chemical synthesis or by isolation from promoters that include such elements, and they can be synthesized with additional flanking nucleotides that contain useful restriction enzyme sites to facilitate subsequence manipulation.

The "expression pattern" of a promoter (with or without enhancer) is the pattern of expression levels, which shows where in the plant and in what developmental stage transcription is initiated by said promoter. Expression patterns of a set of promoters are said to be complementary when the expression pattern of one promoter shows little overlap with the expression pattern of the other promoter. The level of expression of a promoter can be determined by measuring the 'steady state' concentration of a standard transcribed reporter mRNA. This measurement is indirect since the concentration of the reporter mRNA is dependent not only on its synthesis rate, but also on the rate with which the mRNA is degraded. Therefore, the steady state level is the product of synthesis rates and degradation rates. The rate of degradation can however be considered to proceed at a fixed rate when the transcribed sequences are identical, and thus this value can serve as a measure of synthesis rates. When promoters are compared in this way, techniques available to those skilled in the art are hybridization S1-RNAse analysis, northern blots and competitive RT-PCR. This list of techniques in no way represents all available techniques, but rather describes commonly used procedures used to analyze transcription activity and expression levels of mRNA. The analysis of transcription start points in practically all promoters has revealed that there is usually no single base at which transcription starts, but rather a more or less clustered set of initiation sites, each of which accounts for some start points of the mRNA. Since this distribution varies from promoter to promoter the sequences of the reporter mRNA in each of the populations would differ from each other. Since each mRNA species is more or less prone to degradation, no single degradation rate can be expected for different reporter mRNAs. It has been shown for various eukaryotic promoter sequences that the sequence surrounding the initiation site ('initiator') plays an important role in determining the level of RNA expression directed by that specific promoter. This includes also part of the transcribed sequences. The direct fusion of promoter to reporter sequences would therefore lead to suboptimal levels of transcription. A commonly used procedure to analyze expression patterns and levels is through determination of the 'steady state' level of protein accumulation in a cell. Commonly used candidates for the reporter gene, known to those skilled in the art are beta-glucuronidase (GUS), chloramphenicol acetyl transferase (CAT) and proteins with fluorescent properties, such as green fluorescent protein (GFP) from Aequora victoria. In principle, however, many more proteins are suitable for this purpose, provided the protein does not interfere with essential plant functions. For quantification and determination of localization a number of tools are suited. Detection systems can readily be created or are available which are based on, e.g., immunochemical, enzymatic, fluorescent detection and quantification. Protein levels can be determined in plant tissue extracts or in intact tissue using in situ analysis of protein expression. Generally, individual transformed lines with one chimeric promoter reporter construct may vary in their levels of expression of the reporter gene. Also frequently observed is the phenomenon that such transformants do not express any detectable product (RNA or protein). The variability in expression is commonly ascribed to 'position effects', although the molecular mechanisms underlying this inactivity are usually not clear.

"Tissue-specific promoter" refers to regulated promoters that are not expressed in all plant cells but only in one or more cell types in specific organs (such as leaves or seeds), specific tissues (such as embryo or cotyledon), or specific cell types (such as leaf parenchyma or seed storage cells). These also include promoters that are temporally regulated, such as in early or late embryogenesis, during fruit ripening in developing seeds or fruit, in fully differentiated leaf, or at the onset of senescence. For the purposes of the present invention, "tissue-specific" preferably refers to "seed-specific" or "seed-preferential" or embryo-specific or embryo-preferential.

"Seed" as used herein refers, preferably, to whole seed, endosperm and embryonic tissues, more preferably to embryonic tissue. "Specific" in the sense of the invention means that the polynucleotide of interest being operatively linked to the transcription regulating nucleotide sequence referred to herein will be predominantly expressed in the indicated tissues or cells when present in a plant. A predominant expression as meant herein is characterized by a statistically significantly higher amount of detectable transcription in the said tissue or cells with respect to other plant tissues. A statistically significant higher amount of transcription is, preferably, an amount being at least two-fold, three-fold, four-fold, five-fold, ten-fold, hundred-fold, five hundred-fold or thousand-fold the amount found in at least one of the other tissues with detectable transcription. Alternatively, it is an expression in the indicated tissue or cell whereby the amount of transcription in other tissues or cells is less than 1%, 2%, 3%, 4% or, most preferably, 5% of the overall (whole plant) amount of expression. The amount of transcription directly correlates to the amount of transcripts (i.e. RNA) or polypeptides encoded by the transcripts present in a cell or tissue. Suitable techniques for measuring transcription either based on RNA or polypeptides are well known in the art. Tissue or cell specificity alternatively and, preferably in addition to the above, means that the expression is restricted or almost restricted to the indicated tissue or cells, i.e. there is essentially no detectable transcription in other tissues. Almost restricted as meant herein means that unspecific expression is detectable in less than ten, less than five, less than four, less than three, less than two or one other tissue(s). "Seed-preferential" or "embryo-preferential" in the context of this invention means the transcription of a nucleic acid sequence by a transcription regulating element in a way that transcription of said nucleic acid sequence in seeds contribute to more than 50%, preferably more than 70%, more preferably more than 80% of the entire quantity of the RNA transcribed from said nucleic acid sequence in the entire plant during any of its developmental stage.

"Expression" refers to the transcription and/or translation of an endogenous gene, ORF or portion thereof, or a transgene in plants. For example, in the case of antisense constructs, expression may refer to the transcription of the antisense DNA only. In addition, expression refers to the transcription and stable accumulation of sense (mRNA) or functional RNA. Expression may also refer to the production of protein.

Seed specific expression can be determined by comparing the expression of a nucleic acid of interest, e.g., a reporter gene such as GUS, operatively linked to the expression control sequence in the following tissues and stages: 1) roots and leafs at 5-leaf stage, 2) stem at V-7 stage, 3) Leaves, husk, and silk at flowering stage at the first emergence of silk, 4) Spikelets/Tassel at pollination, 5) Ear or Kernels at 5, 10, 15, 20, and 25 days after pollination. Preferably, expression of the nucleic acid of interest can be determined only in Ear or Kernels at 5, 10, 15, 20, and 25 days after pollination in said assay as shown in the accompanying Figures. The expression of the polynucleotide of interest can be determined by various well known techniques, e.g., by Northern Blot or in situ hybridization techniques as described in WO 02/102970, and, preferably, by GUS histochemical analysis as described in the accompanying Examples. Transgenic plants for analyzing seed specific expression can be also generated by techniques well known to the person skilled in the art and as discussed elsewhere in this specification.

The term "nucleic acid" refers to deoxyribonucleotides or ribonucleotides and their polymers thereof in either single- or double-stranded form, composed of monomers (nucleotides) containing a sugar, phosphate and a base, which is either a purine or pyrimidine. Unless specifically limited, the term encompasses nucleic acids containing known analogs of natural nucleotides, which have similar binding properties as the reference nucleic acid and are metabolized in a manner similar to naturally occurring nucleotides. Unless otherwise indicated, a particular nucleic acid sequence also implicitly encompasses conservatively modified variants thereof (e.g., degenerate codon substitutions) and complementary sequences as well as the sequence explicitly indicated. Specifically, degenerate codon substitutions may be achieved by generating sequences in which the third position of one or more selected (or all) codons is substituted with mixed-base and/or deoxyinosine residues (Batzer 1991; Ohtsuka 1985; Rossolini 1994). A "nucleic acid fragment" is a fraction of a given nucleic acid molecule. In higher plants, deoxyribonucleic acid (DNA) is the genetic material while ribonucleic acid (RNA) is involved in the transfer of information contained within DNA into proteins. The term "nucleotide sequence" refers to a polymer of DNA or RNA which can be single- or double-stranded, optionally containing synthetic, non-natural or altered nucleotide bases capable of incorporation into DNA or RNA polymers. The terms "nucleic acid" or "nucleic acid sequence" may also be used interchangeably with gene, cDNA, DNA and RNA encoded by a gene.

The invention encompasses isolated or substantially purified nucleic acid or protein compositions. In the context of the present invention, an "isolated" or "purified" DNA molecule or an "isolated" or "purified" polypeptide is a DNA molecule or polypeptide that, by the hand of man, exists apart from its native environment and is therefore not a product of nature. An isolated DNA molecule or polypeptide may exist in a purified form or may exist in a non-native environment such as, for example, a transgenic host cell. For example, an "isolated" or "purified" nucleic acid molecule or protein, or biologically active portion thereof, is substantially free of other cellular material, or culture medium when produced by recombinant techniques, or substantially free of chemical precursors or other chemicals when chemically synthesized. Preferably, an "isolated" nucleic acid is free of sequences (preferably protein encoding sequences) that naturally flank the nucleic acid (i.e., sequences located at the 5' and 3' ends of the nucleic acid) in the genomic DNA of the organism from which the nucleic acid is derived. For example, in various embodiments, the isolated nucleic acid molecule can contain less than about 5 kb, 4 kb, 3 kb, 2 kb, 1 kb, 0.5 kb, or 0.1 kb of nucleotide sequences that naturally flank the nucleic acid molecule in genomic DNA of the cell from which the nucleic acid is derived. A protein that is substantially free of cellular material includes preparations of protein or polypeptide having less than about 30%, 20%, 10%, 5%, (by dry weight) of contaminating protein. When the protein of the invention, or biologically active portion thereof, is recombinantly produced, preferably culture medium represents less than about 30%, 20%, 10%, or 5% (by dry weight) of chemical precursors or non-protein of interest chemicals. The nucleotide sequences of the invention include both the naturally occurring sequences as well as mutant (variant) forms. Such variants will continue to possess the desired activity, i.e., either promoter activity or the activity of the product encoded by the open reading frame of the non-variant nucleotide sequence.

The term "variant" with respect to a sequence (e.g., a polypeptide or nucleic acid sequence such as—for example—a transcription regulating nucleotide sequence of the invention) is intended to mean substantially similar sequences. For nucleotide sequences comprising an open reading frame, variants include those sequences that, because of the degeneracy of the genetic code, encode the identical amino acid sequence of the native protein. Naturally occurring allelic variants such as these can be identified with the use of well-known molecular biology techniques, as, for example, with polymerase chain reaction (PCR) and hybridization techniques. Variant nucleotide sequences also include synthetically derived nucleotide sequences, such as those generated, for example, by using site-directed mutagenesis and for open reading frames, encode the native protein, as well as those that encode a polypeptide having amino acid substitutions relative to the native protein. Generally, nucleotide sequence variants of the invention will have at least 40, 50, 60, to 70%, e.g., preferably 71%, 72%, 73%, 74%, 75%, 76%, 77%, 78%, to 79%, generally at least 80%, e.g., 81%-84%, at least 85%, e.g., 86%, 87%, 88%, 89%, 90%, 91%, 92%, 93%, 94%, 95%, 96%, 97%, to 98% and 99% nucleotide sequence identity to the native (wild type or endogenous) nucleotide sequence, i.e. for example to SEQ ID NO's: 99, 100, 101, 102, 103, 104, 105, 106, 107, 108, 109, 110, 111, 135, 438, 439, 440, 441, 442, 443, 444, 445, 446, 447, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499, 500, 501, 502, 503, 504, 505, 506, 507, 508, 509, 510, 536, 537, 538, 539, 540, 541, 542, 543, 544, 545, 546, 547, 548, 549, 550, 551, 552, 553, 554, 555, 556, 557, 558, 559, 560, 561, 562, 563, 564, 565, 566, 567, 568, 569, 570, 571, 572, 573, 574, 575, 576, 577, 578, 579, 580, 581, 582, 583, 584, 585, 587, 588, 589, or 591.

The nucleic acid molecules of the invention can be "optimized" for enhanced expression in plants of interest (see, for example, WO 91/16432; Perlak 1991; Murray 1989). In this manner, the open reading frames in genes or gene fragments can be synthesized utilizing plant-preferred codons (see, for example, Campbell & Gown, 1990 for a discussion of host-preferred codon usage). Thus, the nucleotide sequences can be optimized for expression in any plant. It is recognized that all or any part of the gene sequence may be optimized or synthetic. That is, synthetic or partially optimized sequences may also be used. Variant nucleotide sequences and proteins also encompass sequences and protein derived from a mutagenic and recombinogenic procedure such as DNA shuffling. With such a procedure, one or more different coding sequences can be manipulated to create a new polypeptide possessing the desired properties. In this manner, libraries of recombinant polynucleotides are generated from a population of related sequence polynucleotides comprising sequence regions that have substantial sequence identity and can be homologously recombined in vitro or in vivo. Strategies for such DNA shuffling are known in the art (see, for example, Stemmer 1994; Stemmer 1994; Crameri 1997; Moore 1997; Zhang 1997; Crameri 1998; and U.S. Pat. Nos. 5,605,794, 6, 8, 10, and 12,837, 458).

The following terms are used to describe the sequence relationships between two or more nucleic acids or polynucleotides: (a) "reference sequence", (b) "comparison window", (c) "sequence identity", (d) "percentage of sequence identity", and (e) "substantial identity".

(a) As used herein, "reference sequence" is a defined sequence used as a basis for sequence comparison. A reference sequence may be a subset or the entirety of a specified sequence; for example, as a segment of a full-length cDNA or gene sequence, or the complete cDNA or gene sequence.

(b) As used herein, "comparison window" makes reference to a contiguous and specified segment of a polynucleotide sequence, wherein the polynucleotide sequence in the comparison window may comprise additions or deletions (i.e., gaps) compared to the reference sequence (which does not comprise additions or deletions) for optimal alignment of the two sequences. Generally, the comparison window is at least 20 contiguous nucleotides in length, and optionally can be 30, 40, 50, 100, or longer. Those of skill in the art understand that to avoid a high similarity to a reference sequence due to inclusion of gaps in the polynucleotide sequence a gap penalty is typically introduced and is subtracted from the number of matches.

Methods of alignment of sequences for comparison are well known in the art. Thus, the determination of percent identity between any two sequences can be accomplished using a mathematical algorithm. Preferred, non-limiting examples of such mathematical algorithms are the algorithm of Myers and Miller, 1988; the local homology algorithm of Smith et al. 1981; the homology alignment algorithm of Needleman and Wunsch 1970; the search-for-similarity-method of Pearson and Lipman 1988; the algorithm of Karlin and Altschul, 1990, modified as in Karlin and Altschul, 1993.

Computer implementations of these mathematical algorithms can be utilized for comparison of sequences to determine sequence identity. Such implementations include, but are not limited to: CLUSTAL in the PC/Gene program (available from Intelligenetics, Mountain View, Calif.); the ALIGN program (Version 2.0) and GAP, BESTFIT, BLAST, FASTA, and TFASTA in the Wisconsin Genetics Software Package, Version 8 (available from Genetics Computer Group (GCG), 575 Science Drive, Madison, Wis., USA). Alignments using these programs can be performed using the default parameters. The CLUSTAL program is well described (Higgins 1988, 1989; Corpet 1988; Huang 1992; Pearson 1994). The ALIGN program is based on the algorithm of Myers and Miller, supra. The BLAST programs of Altschul et al., 1990, are based on the algorithm of Karlin and Altschul, supra. Multiple aligments (i.e. of more than 2 sequences) are preferably performed using the Clustal W algorithm (Thompson 1994; e.g., in the software VectorNTI™, version 9; Invitrogen Inc.) with the scoring matrix BLOSUM62MT2 with the default settings (gap opening penalty 15/19, gap extension penalty 6.66/0.05; gap separation penalty range 8; % identity for alignment delay 40; using residue specific gaps and hydrophilic residue gaps), Software for performing BLAST analyses is publicly available through the National Center for Biotechnology Information (ncbi.nlm.nih.gov/). This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul 1990). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when the cumulative alignment score falls off by the quantity X from its maximum achieved value, the cumulative score goes to zero or below due to the accumulation of one or more negative-scoring residue alignments, or the end of either sequence is reached.

In addition to calculating percent sequence identity, the BLAST algorithm also performs a statistical analysis of the similarity between two sequences (see, e.g., Karlin & Altschul (1993). One measure of similarity provided by the BLAST algorithm is the smallest sum probability (P(N)), which provides an indication of the probability by which a match between two nucleotide or amino acid sequences would occur by chance. For example, a test nucleic acid sequence is considered similar to a reference sequence if the smallest sum probability in a comparison of the test nucleic acid sequence to the reference nucleic acid sequence is less than about 0.1, more preferably less than about 0.01, and most preferably less than about 0.001.

To obtain gapped alignments for comparison purposes, Gapped BLAST (in BLAST 2.0) can be utilized as described in Altschul et al. 1997. Alternatively, PSI-BLAST (in BLAST 2.0) can be used to perform an iterated search that detects distant relationships between molecules. See Altschul et al., supra. When utilizing BLAST, Gapped BLAST, PSI-BLAST, the default parameters of the respective programs (e.g. BLASTN for nucleotide sequences, BLASTX for proteins) can be used. The BLASTN program (for nucleotide sequences) uses as defaults a wordlength (W) of 11, an expectation (E) of 10, a cutoff of 100, M=5, N=−4, and a comparison of both strands. For amino acid sequences, the BLASTP program uses as defaults a wordlength (W) of 3, an expectation (E) of 10, and the BLOSUM62 scoring matrix (see Henikoff & Henikoff, 1989). See ncbi.nlm.nih-.gov. Alignment may also be performed manually by inspection.

For purposes of the present invention, comparison of nucleotide sequences for determination of percent sequence identity to specific nucleotide sequences (e.g., the promoter sequences disclosed herein) is preferably made using the BlastN program (version 1.4.7 or later) with its default parameters (wordlength (W) of 11, an expectation (E) of 10, a cutoff of 100, M=5, N=−4, and a comparison of both strands) or any equivalent program. By "equivalent program" is intended any sequence comparison program that, for any two sequences in question, generates an alignment having identical nucleotide or amino acid residue matches and an identical percent sequence identity when compared to the corresponding alignment generated by the preferred program.

For purposes of the present invention, comparison of polypeptide or amino acid sequences for determination of percent sequence identity/homology to specific polypeptide or amino acid sequences is preferably made using the BlastP program (version 1.4.7 or later) with its default parameters (wordlength (W) of 3, an expectation (E) of 10, and the BLOSUM62 scoring matrix (Henikoff & Henikoff, 1989); see ncbi.nlm.nih.gov) or any equivalent program. By "equivalent program" is intended any sequence comparison program that, for any two sequences in question, generates an alignment having identical nucleotide or amino acid residue matches and an identical percent sequence identity when compared to the corresponding alignment generated by the preferred program.

(c) As used herein, "sequence identity" or "identity" in the context of two nucleic acid or polypeptide sequences makes reference to the residues in the two sequences that are the same when aligned for maximum correspondence over a specified comparison window. When percentage of sequence identity is used in reference to proteins it is recognized that residue positions which are not identical often differ by conservative amino acid substitutions, where amino acid residues are substituted for other amino acid residues with similar chemical properties (e.g., charge or hydrophobicity) and therefore do not change the functional properties of the molecule. When sequences differ in conservative substitutions, the percent sequence identity may be adjusted upwards to correct for the conservative nature of the substitution. Sequences that differ by such conservative substitutions are said to have "sequence similarity" or "similarity." Means for making this adjustment are well known to those of skill in the art. Typically this involves scoring a conservative substitution as a partial rather than a full mismatch, thereby increasing the percentage sequence identity. Thus, for example, where an identical amino acid is given a score of 1 and a non-conservative substitution is given a score of zero, a conservative substitution is given a score between zero and 1. The scoring of conservative substitutions is calculated, e.g., as implemented in the program PC/GENE (Intelligenetics, Mountain View, Calif.).

(d) As used herein, "percentage of sequence identity" means the value determined by comparing two optimally aligned sequences over a comparison window, wherein the portion of the polynucleotide sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison, and multiplying the result by 100 to yield the percentage of sequence identity.

(e) (i) The term "substantial identity" of polynucleotide sequences means that a polynucleotide comprises a sequence that has at least 38%, e.g., 39%, 40%, 42%, 44%, 46%, 48%, 50%, 52%, 54%, 56%, 58%, 60%, 62%, 64%, 65%, 66%, 67%, 68%, 69%, 70%, 71%, 72%, 73%, 74%, 75%, 76%, 77%, 78%, or 79%, preferably at least 80%, 81%, 82%, 83%, 84%, 85%, 86%, 87%, 88%, or 89%, more preferably at least 90%, 91%, 92%, 93%, or 94%, and most preferably at least 95%, 96%, 97%, 98%, or 99% sequence identity, compared to a reference sequence using one of the alignment programs described using standard parameters. One of skill in the art will recognize that these values can be appropriately adjusted to determine corresponding identity of proteins encoded by two nucleotide sequences by taking into account codon degeneracy, amino acid similarity, reading frame positioning, and the like. Substantial identity of amino acid sequences for these purposes normally means sequence identity of at least 38%, 50% or 60%, preferably at least 70% or 80%, more preferably at least 90%, 95%, and most preferably at least 98%.

Another indication that nucleotide sequences are substantially identical is if two molecules hybridize to each other under stringent conditions (see below). Generally, stringent conditions are selected to be about 5° C. lower than the thermal melting point ($T_m$) for the specific sequence at a defined ionic strength and pH. However, stringent conditions encompass temperatures in the range of about 1° C. to about 20° C., depending upon the desired degree of stringency as otherwise qualified herein. Nucleic acids that do not hybridize to each other under stringent conditions are still substantially identical if the polypeptides they encode are substantially identical. This may occur, e.g., when a copy of a nucleic acid is created using the maximum codon degeneracy permitted by the genetic code. One indication that two nucleic acid sequences are substantially identical is when the polypeptide encoded by the first nucleic acid is immunologically cross reactive with the polypeptide encoded by the second nucleic acid.

(ii) The term "substantial identity" in the context of a peptide indicates that a peptide comprises a sequence with at least 38%, e.g. 39%, 40%, 42%, 44%, 46%, 48%, 50%, 52%, 54%, 56%, 58%, 60%, 62%, 64%, 65%, 66%, 67%, 68%, 69%, 70%, 71%, 72%, 73%, 74%, 75%, 76%, 77%, 78%, or 79%, preferably 80%, 81%, 82%, 83%, 84%, 85%, 86%, 87%, 88%, or 89%, more preferably at least 90%, 91%, 92%, 93%, or 94%, or even more preferably, 95%, 96%, 97%, 98% or 99%, sequence identity to the reference sequence over a specified comparison window. Preferably, optimal alignment is conducted using the homology alignment algorithm of Needleman and Wunsch (1970). An indication that two peptide sequences are substantially identical is that one peptide is immunologically reactive with antibodies raised against the second peptide. Thus, a peptide is substantially identical to a second peptide, for example, where the two peptides differ only by a conservative substitution.

For sequence comparison, typically one sequence acts as a reference sequence to which test sequences are compared. When using a sequence comparison algorithm, test and reference sequences are input into a computer, subsequence coordinates are designated if necessary, and sequence algorithm program parameters are designated. The sequence comparison algorithm then calculates the percent sequence identity for the test sequence(s) relative to the reference sequence, based on the designated program parameters.

As noted above, another indication that two nucleic acid sequences are substantially identical is that the two molecules hybridize to each other under stringent conditions. The phrase "hybridizing specifically to" refers to the binding, duplexing, or hybridizing of a molecule only to a particular nucleotide sequence under stringent conditions when that sequence is present in a complex mixture (e.g., total cellular) DNA or RNA. "Bind(s) substantially" refers to complementary hybridization between a probe nucleic acid and a target nucleic acid and embraces minor mismatches that can be accommodated by reducing the stringency of the hybridization media to achieve the desired detection of the target nucleic acid sequence.

"Stringent hybridization conditions" and "stringent hybridization wash conditions" in the context of nucleic acid hybridization experiments such as Southern and Northern hybridization are sequence dependent, and are different under different environmental parameters. The $T_m$ is the temperature (under defined ionic strength and pH) at which 50% of the target sequence hybridizes to a perfectly matched probe. Specificity is typically the function of post-hybridization washes, the critical factors being the ionic strength and temperature of the final wash solution. For DNA-DNA hybrids, the $T_m$ can be approximated from the equation of Meinkoth and Wahl, 1984:

$$T_m = 81.5° C. + 16.6 (\log_{10} M) + 0.41 (\% GC) - 0.61 (\% form) - 500/L$$

where M is the molarity of monovalent cations, % GC is the percentage of guanosine and cytosine nucleotides in the DNA, % form is the percentage of formamide in the hybridization solution, and L is the length of the hybrid in base pairs. $T_m$ is reduced by about 1° C. for each 1% of mismatching; thus, $T_m$, hybridization, and/or wash conditions can be adjusted to hybridize to sequences of the desired identity. For example, if sequences with >90% identity are sought, the $T_m$ can be decreased 10° C. Generally, stringent conditions are selected to be about 5° C. lower than the thermal melting point I for the specific sequence and its complement at a defined ionic strength and pH. However, severely stringent conditions can utilize a hybridization and/or wash at 1, 2, 3, or 4° C. lower than the thermal melting point I; moderately stringent conditions can utilize a hybridization and/or wash at 6, 7, 8, 9, or 10° C. lower than the thermal melting point I; low stringency conditions can utilize a hybridization and/or wash at 11, 12, 13, 14, 15, or 20° C. lower than the thermal melting point I. Using the equation, hybridization and wash compositions, and desired T, those of ordinary skill will understand that variations in the stringency of hybridization and/or wash solutions are inherently described. If the desired degree of mismatching results in a T of less than 45° C. (aqueous solution) or 32° C. (formamide solution), it is preferred to increase the SSC concentration so that a higher temperature can be used. An extensive guide to the hybridization of nucleic acids is found in Tijssen, 1993. Generally, highly stringent hybridization and wash conditions are selected to be about 5° C. lower than the thermal melting point $T_m$ for the specific sequence at a defined ionic strength and pH.

An example of highly stringent wash conditions is 0.15 M NaCl at 72° C. for about 15 minutes. An example of stringent wash conditions is a 0.2×SSC wash at 65° C. for 15 minutes (see, Sambrook, infra, for a description of SSC buffer). Often, a high stringency wash is preceded by a low stringency wash to remove background probe signal. An example medium stringency wash for a duplex of, e.g., more than 100 nucleotides, is 1×SSC at 45° C. for 15 minutes. An example low stringency wash for a duplex of, e.g., more than 100 nucleotides, is 4 to 6×SSC at 40° C. for 15 minutes. For short probes (e.g., about 10 to 50 nucleotides), stringent conditions typically involve salt concentrations of less than about 1.5 M, more preferably about 0.01 to 1.0 M, Na ion concentration (or other salts) at pH 7.0 to 8.3, and the temperature is typically at least about 30° C. and at least about 60° C. for long robes (e.g., >50 nucleotides). Stringent conditions may also be achieved with the addition of destabilizing agents such as formamide. In general, a signal to noise ratio of 2× (or higher) than that observed for an unrelated probe in the particular hybridization assay indicates detection of a specific hybridization. Nucleic acids that do not hybridize to each other under stringent conditions are still substantially identical if the proteins that they encode are substantially identical. This occurs, e.g., when a copy of a nucleic acid is created using the maximum codon degeneracy permitted by the genetic code.

Very stringent conditions are selected to be equal to the $T_m$ for a particular probe. An example of highly stringent conditions for hybridization of complementary nucleic acids which have more than 100 complementary residues on a filter in a Southern or Northern blot is 50% formamide, e.g., hybridization in 50% formamide, 1 M NaCl, 1% SDS at 37° C., and a wash in 0.1×SSC at 60 to 65° C. Exemplary low stringency conditions include hybridization with a buffer solution of 30 to 35% formamide, 1 M NaCl, 1% SDS (sodium dodecyl sulphate) at 37° C., and a wash in 1× to 2×SSC (20×SSC=3.0 M NaCl/0.3 M trisodium citrate) at 50 to 55° C. Exemplary moderate stringency conditions include hybridization in 40 to 45% formamide, 1.0 M NaCl, 1% SOS at 37° C., and a wash in 0.5× to 1×SSC at 55 to 60° C.

The following are examples of sets of hybridization/wash conditions that may be used to clone nucleotide sequences that are substantially identical to reference nucleotide sequences of the present invention: a reference nucleotide sequence preferably hybridizes to the reference nucleotide sequence in 7% sodium dodecyl sulfate (SDS), 0.5 M $NaPO_4$, 1 mM EDTA at 50° C. with washing in 2×SSC, 0.1% SDS at 50° C. (very low stringency conditions), more desirably in 7% sodium dodecyl sulfate (SDS), 0.5 M $NaPO_4$, 1 mM EDTA at 50° C. with washing in 1×SSC, 0.1% SDS at 50° C. (low stringency conditions), more desirably still in 7% sodium dodecyl sulfate (SDS), 0.5 M $NaPO_4$, 1 mM EDTA at 50° C. with washing in 0.5×SSC, 0.1% SDS at 50° C. (moderate stringency conditions), preferably in 7% sodium dodecyl sulfate (SDS), 0.5 M $NaPO_4$, 1 mM EDTA at 50° C. with washing in 0.1×SSC, 0.1% SOS at 50° C. (high stringency conditions), more preferably in 7% sodium dodecyl sulfate (SDS), 0.5 M $NaPO_4$, 1 mM EDTA at 50° C. with washing in 0.1×SSC, 0.1% SDS at 65° C. (very high stringency conditions).

The terms "open reading frame" and "ORF" refer to the amino acid sequence encoded between translation initiation and termination codons of a coding sequence. The terms "initiation codon" and "termination codon" refer to a unit of three adjacent nucleotides ('codon') in a coding sequence that specifies initiation and chain termination, respectively, of protein synthesis (mRNA translation).

"Encoding" or "Coding sequence" refers to a DNA or RNA sequence that codes for a specific amino acid sequence and excludes the non-coding sequences. It may constitute an "uninterrupted coding sequence", i.e., lacking an intron, such as in a cDNA or it may include one or more introns bounded by appropriate splice junctions. An "intron" is a sequence of RNA which is contained in the primary transcript but which is removed through cleavage and religation of the RNA within the cell to create the mature mRNA that can be translated into a protein.

"Operably-linked" or "functionally linked" refers preferably to the association of nucleic acid sequences on single nucleic acid fragment so that the function of one is affected by the other. For example, a regulatory DNA sequence is said to be "operably linked to" or "associated with" a DNA sequence that codes for an RNA or a polypeptide if the two sequences are situated such that the regulatory DNA sequence affects expression of the coding DNA sequence (i.e., that the coding sequence or functional RNA is under the transcriptional control of the promoter). Coding sequences can be operably-linked to regulatory sequences in sense or antisense orientation.

The terms "heterologous DNA sequence", "exogenous DNA segment" or "heterologous nucleic acid," generally refer to a sequence that originates from a source foreign to the particular host cell or, if from the same source, is modified from its original form. "Heterologous" generally refers to the nucleic acid sequences that are not endogenous to the cell or part of the native genome in which they are present, and have been added to the cell by infection, transfection, microinjection, electroporation, microprojection, or the like. Thus, a heterologous gene in a host cell includes a gene that is endogenous to the particular host cell but has been modified through, for example, the use of DNA shuffling. The terms also include non-naturally occurring multiple copies of a naturally occurring DNA sequence. Thus, the terms refer to a DNA segment that is foreign or heterologous to the cell, or homologous to the cell but in a position within the host cell nucleic acid in which the element is not ordinarily found. Exogenous DNA segments are expressed to yield exogenous polypeptides. In the context of the present invention, "heterologous nucleic acid sequence" encoding a polypeptide of interest is intended a sequence that is not naturally operably linked with the dual transit peptide encoding sequence of the invention, including non-naturally occurring multiple copies of a naturally occurring DNA sequence. While this nucleotide sequence is heterologous to the dual transit peptide encoding sequence, it may be homologous, or "native," or heterologous, or "foreign," to the plant host. In some cases, the transformed plant may have a change in phenotype.

"Homologous to" in the context of nucleotide sequence identity refers to the similarity between the nucleotide sequences of two nucleic acid molecules or between the amino acid sequences of two protein molecules. Estimates of such homology are provided by either DNA-DNA or DNA-RNA hybridization under conditions of stringency as is well understood by those skilled in the art (as described in Haines and Higgins (eds.), Nucleic Acid Hybridization, IRL Press, Oxford, U.K.), or by the comparison of sequence similarity between two nucleic acids or proteins.

"Vector" is defined to include, inter glia, any plasmid, cosmid, phage or Agrobacterium binary nucleic acid molecule in double or single stranded linear or circular form which may or may not be self transmissible or mobilizable, and which can transform prokaryotic or eukaryotic host either by integration into the cellular genome or exist extrachromosomally (e.g. autonomous replicating plasmid with an origin of replication).

Specifically included are shuttle vectors by which is meant a DNA vehicle capable, naturally or by design, of replication in two different host organisms, which may be selected from actinomycetes and related species, bacteria and eukaryotic (e.g. higher plant, mammalian, yeast or fungal cells).

Preferably the nucleic acid in the vector is under the control of, and operably linked to, an appropriate promoter or other regulatory elements for transcription in a host cell such as a microbial, e.g. bacterial, or plant cell. The vector may be a bi-functional expression vector which functions in multiple hosts. In the case of genomic DNA, this may contain its own promoter or other regulatory elements and in the case of cDNA this may be under the control of an appropriate promoter or other regulatory elements for expression in the host cell.

"Cloning vectors" typically contain one or a small number of restriction endonuclease recognition sites at which foreign DNA sequences can be inserted in a determinable fashion without loss of essential biological function of the vector, as well as a marker gene that is suitable for use in the identification and selection of cells transformed with the cloning vector. Marker genes typically include genes that provide tetracycline resistance, hygromycin resistance, kanamycin resistance, streptomycin resistance or ampicillin resistance.

A "transgene" or "trangenic" refers to a gene that has been introduced into the genome by transformation and is stably or transiently maintained. Transgenes may include, for example, genes that are either heterologous or homologous to the genes of a particular plant to be transformed. Additionally, transgenes may comprise native genes inserted into a non-native organism, or chimeric genes. The term "endogenous gene" refers to a native gene in its natural location in the genome of an organism. A "foreign" gene refers to a gene not normally found in the host organism but that is introduced by gene transfer.

The term "transformation" refers to the transfer of a nucleic acid fragment into the genome of a host cell. Host cells containing the transformed nucleic acid fragments are referred to as "transgenic" cells, and organisms comprising transgenic cells are referred to as "transgenic organisms". Examples of methods of transformation of plants and plant cells include Agrobacterium-mediated transformation (De Blaere 1987) and particle bombardment technology (U.S. Pat. No. 4,945,050). Whole plants may be regenerated from transgenic cells by methods well known to the skilled artisan (see, for example, Fromm 1990).

"Transformed," "transgenic and "recombinant" refer to a host organism such as a bacterium or a plant into which a heterologous nucleic acid molecule has been introduced. The nucleic acid molecule can be stably integrated into the genome generally known in the art and are disclosed (Sambrook 1989; Innis 1995; Gelfand 1995; Innis & Gelfand 1999). For example, "transformed," "transformant," and "transgenic" plants or calli have been through the transformation process and contain a foreign gene integrated into their chromosome. The term "untransformed" refers to normal plants that have not been through the transformation process. A polynucleotide or polypeptide is "recombinant" when it is artificial or engineered, or derived from an artificial or engineered protein or nucleic acid. For example, a polynucleotide that is inserted into a vector or any other heterologous location, e.g., in a genome of a recombinant organism, such that it is not associated with nucleotide sequences that normally flank the polynucleotide as it is found in nature is a recombinant polynucleotide. A polypeptide expressed in vitro or in vivo from a recombinant polynucleotide is an example of a recombinant polypeptide. Likewise, a polynucleotide sequence that does not appear in nature, for example, a variant of a naturally occurring gene is recombinant.

"Transiently transformed" refers to cells in which transgenes and foreign DNA have been introduced (for example, by such methods as Agrobacterium-mediated transformation or biolistic bombardment), but not selected for stable maintenance.

"Stably transformed" refers to cells that have been selected and regenerated on a selection media following transformation.

"Chromosomally-integrated" refers to the integration of a foreign gene or DNA construct into the host genome by covalent bonds. Where genes are not "chromosomally integrated", they may be "transiently expressed". Transient expression of a gene refers to the expression of a gene that is not integrated into the host chromosome but functions independently, either as part of an autonomously replicating plasmid or expression cassette, for example, or as part of another biological system such as a virus. "Genetically stable" and "heritable" refer to chromosomally-integrated genetic elements that are stably maintained in the plant and stably inherited by progeny through successive generations.

A "transgenic plant" is a plant having one or more plant cells that contain an expression vector as defined hereinafter in the detailed description.

"Primary transformant" and "T0 generation" refer to transgenic plants that are of the same genetic generation as the tissue which was initially transformed (i.e., not having gone through meiosis and fertilization since transformation).

"Secondary transformants" and the "T1, T2, T3, etc. generations" refer to transgenic plants derived from primary transformants through one or more meiotic and fertilization cycles. They may be derived by self-fertilization of primary or secondary transformants or crosses of primary or secondary transformants with other transformed or untransformed plants.

"Plant tissue" includes differentiated and undifferentiated tissues or plants, including but not limited to roots, stems, shoots, leaves, pollen, seeds, tumor tissue and various forms of cells and culture such as single cells, protoplast, embryos, and callus tissue. The plant tissue may be in plants or in organ, tissue or cell culture.

The term "altered plant trait" means any phenotypic or genotypic change in a transgenic plant relative to the wild-type or non-transgenic plant host.

The word "plant" refers to any plant, particularly to agronomically useful plants (e.g., seed plants), and "plant cell" is a structural and physiological unit of the plant, which comprises a cell wall but may also refer to a protoplast. The plant cell may be in form of an isolated single cell or a cultured cell, or as a part of higher organized unit such as, for example, a plant tissue, or a plant organ differentiated into a structure that is present at any stage of a plant's development, Such structures include one or more plant organs including, but are not limited to, fruit, shoot, stem, leaf, flower petal, etc. Preferably, the term "plant" includes whole plants, shoot vegetative organs/structures (e.g. leaves, stems and tubers), roots, flowers and floral organs/structures (e.g. bracts, sepals, petals, stamens, carpels, anthers and ovules), seeds (including embryo, endosperm, and seed coat) and fruits (the mature ovary), plant tissues (e.g. vascular tissue, ground tissue, and the like) and cells (e.g. guard cells, egg cells, trichomes and the like), and progeny of same. The class of plants that can be used in the method of the invention is generally as broad as the class of higher and lower plants amenable to transformation techniques, including angiosperms (monocotyledonous and dicotyledonous plants), gymnosperms, ferns, and multicellular algae. It includes plants of a variety of ploidy levels, including aneuploid, polyploid, diploid, haploid and hemizygous. Included within the scope of the invention are all genera and species of higher and lower plants of the plant kingdom. Included are furthermore the mature plants, seed, shoots and seedlings, and parts, propagation material (for example seeds and fruit) and cultures, for example cell cultures, derived therefrom.

DETAILED DESCRIPTION

Accordingly, a first embodiment of the present invention relates to recombinant chimeric nucleic acid molecule comprising a nucleic acid sequence encoding a dual transit peptide operably linked to a heterologous nucleic acid sequence encoding a polypeptide of interest.

As used herein, the term "dual transit peptide" refers to the N-terminal portion of a chloroplast and/or mitochondrial precursor protein and is instrumental for specific recognition of the chloroplast and/or mitochondrial surface and in mediating the post-translational translocation of pre-proteins across the chloroplast envelope and into the various subcompartments within the chloroplast (e.g., stroma, thylakoid and thylakoid membrane) and/or mitochondrion. Thus, as used herein, a polypeptide having "dual transit peptide activity" comprises a polypeptide which when operably linked to the N-terminal region of a protein of interest facilitates translocation of the polypeptide of interest to the chloroplast and/or mitochondrion.

The term "chimeric" sequence refers to a sequence having two or more heterologous sequences linked together. As used herein, a "heterologous" dual transit peptide comprises a transit peptide sequence which is foreign to the polypeptide of interest it is operably linked to.

In one embodiment, the dual transit peptides disclosed herein provide improved translocation compared to dual transit peptides derived from, for example, higher plant organisms. The dual transit peptides disclosed herein may result in an at least about 20%, at least about 30%, at least about 40%, at least about 50%, at feast about 60%, at least about 70%, at least about 80%, at least about 90%, at least about 100%, or greater, or at least about 2-fold, at least about 3-fold, at least about 4-fold, or greater improvement in translocation of the polypeptide into the chloroplast and/or mitochondrion when compared to a reference transit peptide. An improvement can be measured in terms of the amount of polypeptide that gets translocated into the chloroplast and/or mitochondrion, the amount of active polypeptide that gets translocated into the chloroplast and/or mitochondrion, or both. An improvement can also be measured in terms of an improvement in the phenotype of an organism transformed with the chloroplast and/or mitochondrion-targeted protein of interest. For example, where the dual transit peptide of the invention is used to target an herbicide resistance protein to the chloroplast and/or mitochondrion of the plant, an improvement in activity can be measured in terms of an improvement in herbicide resistance.

The inventors of the present invention have surprisingly found that linking the N-terminal dual transit peptide of a type-2 protoporphyrinogen oxidase (PPO-2) of plant species that are considered to be classified as "weeds" to polypeptides of interest which are heterologous to the transit peptide improves the translocation of said polypeptides of interest into the chloroplast and/or mitochondrion.

The website weedscience.org/ provides a comprehensive list of these so-called weed species, some of which may be herbicide resistant or tolerant. The person skilled in the art will recognize that the dual transit peptides of PPO-2 polypeptides from various weed species as well as dual transit peptides having a high similarity to the dual transit peptide of PPO-2 polypeptides are encompassed by the present invention.

Specifically, those weed species include *Abutilon theophrasti, Acalypha australis, Ageratum conyzoides, Agrostis stolonifera, Alisma canaliculatum, Alisma plantago*-aquatics, *Alopecurus aequalis, Alopecurus japonicas, Alopecurus myosuroides, Amaranthus albus, Amaranthus blitoides, Amaranthus blitum* (ssp. *oleraceus*), *Amaranthus cruentus, Amaranthus hybridus* (syn: *quitensis*), *Amaranthus palmeri, Amaranthus powellii, Amaranthus retroflexus, Amaranthus spinosus, Amaranthus tuberculatus* (=*A. rudis*), *Amaranthus viridis, Ambrosia artemisiifolia, Ambrosia trifida, Ammannia auriculata, Ammannia coccinea, Anthemis arvensis, Anthemis cotula, Apera spica*-venti, *Arabidopsis thaliana, Arctotheca calendula, Arenaria serpyllifolia, Atriplex patula, Avena fatua, Avena sterilis, Avena sterilis* ssp. *Ludoviciana, Bacopa rotundifolia, Beckmannia syzigachne, Bidens pilosa, Bidens subalternans, Bidens tripartite, Bifora radians, Blyxa aubertii, Brachiaria eruciformis, Brachypodium distachyon, Brassica raps* (=*B. campestris*), *Brassica*

*tournefortii, Bromus diandrus, Bromus diandrus* ssp. *rigidus* (=*B. rigidus*), *Bromus japonicas, Bromus rubens, Bromus secalinus, Bromus sterilis, Bromus tectorum, Buglossoides arvensis* (=*Lithospermum arvense*), *Camelina microcarpa, Capsella bursa-pastoris, Carduus nutans. Carduus pycnocephalus, Centaurea cyanus, Centaurea solstitialis, Chenopodium album, Chenopodium album* var. *striatum* (=*C. strictum* var. *glaucophyllum*), *Chenopodium ficifolium, Chenopodium polyspermum, Chenopodium simplex* (=*C. hybridum*), *Chloris barbata*=(*C. inflate*), *Chloris elata, Chloris truncate, Chloris virgate, Chrysanthemum coronarium, Cirsium arvense, Clidemia hirta, Commelina diffusa, Convolvulus arvensis, Conyza bonariensis, Conyza Canadensis, Conyza sumatrensis, Crassocephalum crepidioides, Crepis tectorum, Crypsis schoenoides, Cuphea carthagenensis, Cuscuta pentagona* (=*C. campestris*), *Cynodon hirsutus, Cynosurus echinatus, Cyperus brevifolius, Cyperus compressus, Cyperus difformis, Cyperus esculentus, Cyperus iria, Cyperus odoratus, Damasonium minus, Datura stramonium, Daucus carota, Descurainia Sophia, Digitaria ciliaris, Digitaria insularis, Digitaria ischaemum, Digitaria sanguinalis, Diplotaxis erucoides, Diplotaxis tenuifolia, Dopatrium junceum, Echinochloa colona, Echinochloa crus-galli* var. *crus-galli, Echinochloa crus-galli* var. *formosensis, Echinochloa crusgalli* var. *zelayensis, Echinochloa crus-pavonis, Echinochloa erecta, Echinochloa oryzoides, Echinochloa phyllopogon* (=*E. oryzicola*), *Echium plantagineum, Ehrharta longiflora, Elatine triandra* var. *pedicellata, Eleocharis acicularis, Eleusine indica, Epilobium ciliatum, Epilobium tetragonum, Erigeron philadelphicus, Eriochloa punctate, Erucaria hispanica, Erysimum repandum, Euphorbia heterophylla, Fimbristylis miliacea, Fumaria densiflora, Galeopsis tetrahit, Galinsoga ciliate, Galium aparine, Galium spurium, Galium tricornutum, Gamochaeta pensylvanica, Hedyotis verticillata, Helianthus annuus, Hirschfeldia incana, Hordeum murinum* ssp. *Glaucum, Hordeum murinum* ssp. *Leporinum, Hydrilla verticillata, lschaemum rugosum, Iva xanthifolia, Ixophorus unisetus, Kochia scoparia, Lactuca serriola, Lamium amplexicaule, Landoltia punctate, Lepidium virginicum, Leptochloa chinensis, Leptochloa panicoides, Leptochroa scabra, Leptochloa virgate, Limnocharis flava, Limnophila erecta, Limnophila sessiliflora, Lindernia dubia* (=*Lindernia dubia* var. *Major*), *Lindernia micrantha, Lindernia procumbens, Lolium perenne, Lolium perenne* ssp. *Multiflorum, Lolium persicum, Lolium rigidum, Ludwigia prostrata, Matricaria discoidea, Matricaria recutita* (=*M. chamomilla*), *Mazus fauriei, Mazus pumilus, Mesembryanthemum crystallinum, Mitracarpus hirtus, Monochoria korsakowii, Monochoria vaginalis, Myosoton aquaticum, Nassella neesiana, Nassella trichotoma, Neslia paniculata, Oryza sativa* var. *sylvatica, Panicum capillare, Panicum dichotorniflorum, Papaver rhoeas, Parthenium hysterophores, Pentzia suffruticosa, Phalaris brachystachys, Phalaris minor, Phalaris paradoxa, Picris hieracioides, Plantago lagopus, Plantago lanceolate, Poa annua, Polygonum aviculare, Polygonum convolvulus* (=*Fallopia convolvulus*), *Polygonum hydropiper, Polygonum lapathifolium, Polygonum pensylvanicum, Polygonum persicaria, Polypogon fugax, Polypogon monspeliensis, Portulaca oleracea, Ranunculus acris, Raphanus raphanistrum, Raphanus sativus, Rapistrum rugosum, Rorippa indica, Rostraria smyrnacea* (=*Lophochloa smyrnacea*), *Rotala indica* var. *uliginosa, Rotala pusilla, Rottboellia cochinchinensis* (=*R. exaltata*), *Rumex dentatus, Sagittaria guyanensis, Sagittaria montevidensis, Sagittaria pygmaea, Sagittaria trifolia, Salsola tragus, Schoenoplectus fluviatilis, Schoenoplectus juncoides, Schoenoplectus mucronatus* (=*Scirpus mucronatus*), *Schoenoplectus wallichii, Sclerochloa dura, Sclerochloa kengiana, Senecio vernalis, Senecio vulgaris, Setaria faberi, Setaria pumila* (=*S. glauca*), *Setaria verticillata, Setaria viridis, Setaria viridis* var. *Major* (=var. *robusta-alba*, var. *robustapurpurea*), *Sida spinose, Silene gallica, Sinapis alba, Sinapis arvensis, Sisymbrium orientale, Sisymbrium thellungii, Snowdenia polystachya, Solanum americanum, Solanum nigrum, Solanum ptycanthum, Soliva sessilis, Sonchus asper, Sonchus oleraceus, Sorghum bicolor, Sorghum bicolor* ssp. *drummondii* (=*Sorghum sudanese*), *Sorghum halepense, Spergula arvensis, Sphenoclea zeylanica, Sporobolus fertilis, Stellaria media, Thlaspi arvense, Tripleurospermum perforatum* (=*T. inodorum*), *Urochloa panicoides, Urochloa plantaginea* (=*Brachiaria plantaginea*), *Urtica urens, Vaccaria hispanica, Vicia sativa, Vulpia bromoides, Xanthium strumarium, Youngia japonica.*

In a preferred embodiment, said dual transit peptide is from the genus *Amaranthus* or from the genus *Alopecurus*.

It might be envisaged that the dual transit peptides of other polypeptides, other PPO-2 or PPO-2-like polypeptides from other plant species which have a certain degree of homology to the PPO-2 dual transit peptide from the genus *Amaranthus* or from the genus *Alopecurus*, will be useful and, thus, encompassed by the present invention.

Consequently, in another preferred embodiment, said dual transit peptide comprises the amino acid sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, or a variant or fragment thereof.

By "fragment" is intended a portion of the polynucleotide or a portion of the amino acid sequence and hence protein encoded thereby. Fragments of a polynucleotide may encode protein fragments that retain dual transit peptide activity and are thus capable of facilitating the translocation of a polypeptide of interest into the chloroplast and/or mitochondrion of a plant. Alternatively, fragments of a polynucleotide that is useful as a hybridization probe generally do not encode fragment proteins retaining biological activity. Thus, fragments of a nucleotide sequence may range from at least about 10, 20, 30, 40, 50, 60, 70, 80, 90, 100, 110, 120, 130, 140, 150, 160, 170 nucleotides or up to the full length dual transit peptide. A fragment of polynucleotide that encodes a biologically active portion of a dual transit peptide will encode at least 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 60, 65, 70, 75, 80, 85 contiguous amino acids, or up to the total number of amino acids present in any one of SEQ ID NOs: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, or 98.

The term "variant" with respect to a sequence (e.g., a polypeptide or nucleic acid sequence such as—for example—a transcription regulating nucleotide sequence of the invention) is intended to mean substantially similar sequences. For nucleotide sequences comprising an open reading frame, variants include those sequences that, because of the degeneracy of the genetic code, encode the identical amino acid sequence of the native protein. Naturally occurring allelic variants such as these can be identified with the use of well-known molecular biology techniques, as, for example, with polymerase chain reaction (PCR) and hybridization techniques. Variant nucleotide sequences also include synthetically derived nucleotide sequences, such as those generated, for example, by using site-directed mutagenesis and for open reading frames, encode the native protein, as well as those that encode a polypeptide having amino acid substitutions relative to the native protein, e.g. the chimeric polypeptide according to the present invention as disclosed herein.

Generally, nucleotide sequence variants of the invention will have at least 30, 40, 50, 60, to 70%, e.g., preferably 71%, 72%, 73%, 74%, 75%, 76%, 77%, 78%, to 79%, generally at least 80%, e.g., 81%-84%, at least 85%, e.g., 86%, 87%, 88%, 89%, 90%, 91%, 92%, 93%, 94%, 95%, 96%, 97%, to 98% and 99% nucleotide "sequence identity" to the nucleotide sequence set foth in SEQ ID NO: 99, 100, 101, 102, 103, 104, 105, 106, 107, 108, 109, 110, 111, 135, 438, 439, 440, 441, 442, 443, 444, 445, 446, 447, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499, 500, 501, 502, 503, 504, 505, 506, 507, 508, 509, 510, 536, 537, 538, 539, 540, 541, 542, 543, 544, 545, 546, 547, 548, 549, 550, 551, 552, 553, 554, 555, 556, 557, 558, 559, 560, 561, 562, 563, 564, 565, 566, 567, 568, 569, 570, 571, 572, 573, 574, 575, 576, 577, 578, 579, 580, 581, 582, 583, 584, 585, 587, 588, 589, or 591. The % identity of a polynucleotide is determined by GAP (Needleman and Wunsch, 1970) analysis (GCG program) with a gap creation penalty=5, and a gap extension penalty=0.3. Unless stated otherwise, the query sequence is at least 45 nucleotides in length, and the GAP analysis aligns the two sequences over a region of at least 45 nucleotides. Preferably, the query sequence is at least 150 nucleotides in length, and the GAP analysis aligns the two sequences over a region of at least 150 nucleotides. More preferably, the query sequence is at least 300 nucleotides in length and the GAP analysis aligns the two sequences over a region of at least 300 nucleotides. Even more preferably, the GAP analysis aligns the two sequences over their entire length.

Moreover, nucleotide sequence variants of the invention will have at least 30, 40, 50, 60, to 70%, e.g., preferably 71%, 72%, 73%, 74%, 75%, 76%, 77%, 78%, to 79%, generally at least 80%, e.g., 81%-84%, at least 85%, e.g., 86%, 87%, 88%, 89%, 90%, 91%, 92%, 93%, 94%, 95%, 96%, 97%, to 98% and 99% nucleotide "sequence identity" to the nucleotide sequence encoding a dual transit peptide of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, or 98. The % identity of a polynucleotide is determined by GAP (Needleman and Wunsch, 1970) analysis (GCG program) with a gap creation penalty=5, and a gap extension penalty=0.3. Unless stated otherwise, the query sequence is at least 45 nucleotides in length, and the GAP analysis aligns the two sequences over a region of at least 45 nucleotides. Preferably, the query sequence is at least 150 nucleotides in length, and the GAP analysis aligns the two sequences over a region of at least 150 nucleotides. More preferably, the query sequence is at least 300 nucleotides in length and the GAP analysis aligns the two sequences over a region of at least 300 nucleotides. Even more preferably, the GAP analysis aligns the two sequences over their entire length.

With regard to a defined polypeptide, it will be appreciated that % identity figures higher than those provided above will encompass preferred embodiments. Thus, where applicable, in light of the minimum % identity figures, it is preferred that the PRO polypeptide of the invention comprises an amino acid sequence which is at least 40%, more preferably at least 45%, more preferably at least 50%, more preferably at least 55%, more preferably at least 60%, more preferably at least 65%, more preferably at least 70%, more preferably at least 75%, more preferably at least 80%, more preferably at least 85%, more preferably at least 90%, more preferably at least 91%, more preferably at least 92%, more preferably at least 93%, more preferably at least 94%, more preferably at least 95%, more preferably at least 96%, more preferably at least 97%, more preferably at least 98%, more preferably at least 99%, more preferably at least 99.1%, more preferably at least 99.2%, more preferably at least 99.3%, more preferably at least 99.4%, more preferably at least 99.5%, more preferably at least 99.6%, more preferably at least 99.7%, more preferably at least 99.8%, and even more preferably at least 99.9% identical to SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 448, 449, 450, 451, 452, 453, 454, 455, 456, 457, 458, 459, 460, 461, 462, 463, 464, 465, 466, 467, 468, 511, 512, 513, 514, 515, 516, 517, 518, 519, 520, 521, 522, 523, 524, 525, 526, 527, 528, 529, 530, 531, 532, 533, 534, or 535.

By "variant" polypeptide is intended a polypeptide derived from the protein of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 448, 449, 450, 451, 452, 453, 454, 455, 456, 457, 458, 459, 460, 461, 462, 463, 464, 465, 466, 467, 468, 511, 512, 513, 514, 515, 516, 517, 518, 519, 520, 521, 522, 523, 524, 525, 526, 527, 528, 529, 530, 531, 532, 533, 534, or 535, by deletion (so-called truncation) or addition of one or more amino acids to the N-terminal and/or C-terminal end of the full length dual transit peptide; deletion or addition of one or more amino acids at one or more sites in the full length dual transit peptide; or substitution of one or more amino acids at one or more sites in the native protein. Such variants may result from, for example, genetic polymorphism or from human manipulation. Methods for such manipulations are generally known in the art.

In addition, the various dual transit peptides disclosed herein can be modified to improve and/or alter the translocation of the polypeptide of interest into the chloroplast. For example, the dual transit peptide can contain additional regions that alter or improve the interactions with cytosolic factors that facilitate the passage of precursors from the ribosomes to the chloroplast surface. See, for example, Hiltbrunner et al. (2001) Journal of Cell Biology 154:309-316, Jackson-Constan et al. (2001) Biochimica et Biophysica Acta 1541: 102-113, both of which are herein incorporated by reference. Other regions can be employed to increase the efficiency of organelle import. See, for example, May et al. (2000) Plant Cell 12:53-64, Qbadou et al. (2006) EMB Journal 25: 1837-1837 and Sohrt et al. (2000) Journal of Cell Biology 148: 1213-1221, herein incorporated by reference. Such regions may be native (derived from a region of the PPO-2 polypeptide) or heterologous to the operably linked PPO-2 dual transit peptide. Assays to determine the efficiency by which the dual transit peptide sequences of the invention target a protein of interest to a chloroplast are known. See, for example, Mishkind et al. (1985) J of Cell. Biol 100:226-234, which is herein incorporated by reference in its entirety. A reporter gene such as glucuronidase (GUS), chloramphenicol acetyl transferase (CAT), or green fluorescent protein (GFP) is operably linked to the dual transit peptide sequence. This fusion is placed behind the control of a suitable promoter, ligated into a transformation vector, and transformed into a plant or plant cell. Following an adequate period of time for expression and localization into the organelle, the organelle fraction is extracted and reporter activity assayed. The ability of the isolated sequences to target and deliver the reporter protein to the chloroplast and/or mitochondrion can be compared to other known dual transit peptide sequences (de Castro Silva Filho et al. (1996) Plant Mol. Biol. 30: 769-780). Protein import can also be verified in vitro through the addition of proteases to the isolated chloroplast fraction. Proteins which were successfully imported into the chloroplast are resistant to the externally added proteases whereas proteins that remain in the cytosol and/or mitochondrion are susceptible to digestion. Protein import can also be verified by the presence of functional protein in the chloroplast and/or mitochondrion using standard molecular techniques for detection, by evaluating the phenotype resulting from expression of a chloroplast and/or mitochondrion targeted protein, or by microscopy.

The dual transit peptides disclosed herein target the desired protein of interest to the chloroplast and/or mitochondrion and can facilitate the protein's translocation into the organelle. This is accompanied by the cleavage of the transit peptide from the mature polypeptide or protein at the appropriate transit peptide cleavage site by a chloroplast processing protease. Accordingly, a dual transit peptide further comprises a suitable cleavage site for the correct processing of the pre-protein to the mature polypeptide contained within the chloroplast.

Any polynucleotide of interest (i.e., the "polypeptide of interest") may be used with the dual transit peptide-encoding sequences disclosed herein. Such polynucleotides/polypeptides of interest include, but are not limited to, herbicide-tolerance coding sequences, insecticidal coding sequences, nematicidal coding sequences, antimicrobial coding sequences, antifungal coding sequences, antiviral coding sequences, abiotic and biotic stress tolerance coding sequences, or sequences modifying plant traits such as yield, grain quality, nutrient content, starch quality and quantity, nitrogen fixation and/or utilization, and oil content and/or composition. More specific polynucleotides of interest for the present invention include, but are not limited to, genes that improve crop yield, polypeptides that improve desirability of crops, genes encoding proteins conferring resistance to abiotic stress, such as drought, nitrogen, temperature, salinity, toxic metals or trace elements, or those conferring resistance to toxins such as pesticides and herbicides, or to biotic stress, such as attacks by fungi, viruses, bacteria, insects, and nematodes, and development of diseases associated with these organisms. It is recognized that any polypeptides of interest can be operably linked to the dual transit peptide-encoding sequences of the invention and expressed in a plant, so long as the polypeptide encoded by the polynucleotide is functional in chloroplasts and/or mitochondria.

Exemplary polynucleotides of interest that may be operably linked to the dual transit peptides of the present invention include polynucleotides encoding: polypeptides having pesticidal and/or insecticidal activity, such as other *Bacillus thuringiensis* toxic proteins (described in U.S. Pat. Nos. 5,366,892; 5,747,450; 5,737,514; 5,723,756; 5,593,881; and Geiser et al., (1986) Gene 48:109), lectins (Van Damme et al. (1994) Plant Mol. Biol. 24:825, pentin (described in U.S. Pat. No. 5,981,722), and the like; traits desirable for disease or herbicide resistance (e.g., fumonisin detoxification genes (U.S. Pat. No. 5,792,931); avirulence and disease resistance genes (Jones et al. (1994) Science 266:789; Martin et al., (1993) Science 262:1432; Mindrinos et al. (1994) Cell 78:1089); acetolactate synthase (ALS)

mutants that lead to herbicide resistance such as the S4 and/or Hra mutations; glyphosate resistance (e.g., 5-enol-pyrovyl-shikimate-3-phosphate-synthase (EPSPS) gene, described in U.S. Pat. Nos. 4,940,935 and 5,188,642; or the glyphosate N-acetyltransferase (GAT) gene, described in Castle et al. (2004) Science, 304:1151-1154; and in U.S. Patent App. Pub. Nos. 20070004912, 20050246798, and 20050060767)); glufosinate resistance (e.g, phosphinothricin acetyl transferase genes PAT and BAR, described in U.S. Pat. Nos. 5,561,236 and 5,276,268); resistance to herbicides including sulfonyl urea, DHT (2,4D), and PPO herbicides (e.g., glyphosate acetyl transferase, aryloxy alkanoate dioxygenase, acetolactate synthase, and protoporphyrinogen oxidase); a cytochrome P450 or variant thereof that confers herbicide resistance or tolerance to, inter alia, HPPD herbicides (U.S. patent application Ser. No. 12/156,247; U.S. Pat. Nos. 6,380,465; 6,121,512; 5,349,127; 6,649,814; and 6,300,544; and PCT Patent App. Pub. No. WO2007000077); and traits desirable for processing or process products such as high oil (e.g., U.S. Pat. No. 6,232,529); modified oils (e.g., fatty acid desaturase genes (U.S. Pat. No. 5,952,544; WO 94/11516)); modified starches (e.g., ADPG pyrophosphorylases (AGPase), starch synthases (SS), starch branching enzymes (SBE), and starch debranching enzymes (SDBE)); and polymers or bioplastics (e.g., U.S. Pat. No. 5,602,321; beta-ketothiolase, polyhydroxybutyrate synthase, and acetoacetyl-CoA reductase (Schubert et al. (1988) J. Bacteriol, 170:5837-5847) facilitate expression of polyhydroxyalkanoates (PHAs)); the disclosures of which are herein incorporated by reference.

In a preferred embodiment, said heterologous polypeptide of interest is a polypeptide which, when overexpressed in a plant, confers herbicide tolerance to said plant. An "herbicide resistance protein" or a protein resulting from expression of an "herbicide resistance-encoding nucleic acid molecule" includes proteins that confer upon a cell the ability to tolerate a higher concentration of an herbicide than cells that do not express the protein, or to tolerate a certain concentration of an herbicide for a longer period of time than cells that do not express the protein. Herbicide resistance traits may be introduced into plants by genes coding for resistance to herbicides that act to inhibit the action of protoporphyrinogen oxidase (PPO), 5-enolpyruvylshikimate-3-phosphate synthase (EPSPS), Glyphosate acetyl transferase (GAT), cytochrome P450 monooxygenase, phosphinothricin acetyltransferase (PAT), Acetohydroxyacid synthase (AHAS; EC 4.1.3.18, also known as acetolactate synthase or ALS), hydroxyphenyl pyruvate dioxygenase (HPPD), Phytoene desaturase (PD) and dicamba degrading enzymes as disclosed in WO 021068607, or phenoxyaceticacid- and phenoxypropionicacid-derivative degrading enzymes as disclosed in WO 2008141154 or WO 2005107437.

In a particularly preferred embodiment, said polypeptide of interest that may be operably linked to the dual transit peptides of the present invention has PPO activity and confers tolerance to PPO-inhibiting herbicides. Protoporphyrinogen oxidase (herein generally referred to as PPO; EC: 1.3.3.4), is a key enzyme in the biosynthesis of protoporphyrin IX, have been used for selective weed control since the 1960s. PPO catalyzes the last common step in chlorophyll and heme biosynthesis which is the oxidation of protoporphyrinogen IX to protoporphyrin IX. (Matringe et al. 1989. Biochem. 1. 260: 231).

Orthologues sequences of PRO polypeptides of interest that are encompassed by the present invention are disclosed in WO2012/080975, WO2013/189984, WO2015/022636, WO2015/022640, WO2015/022639, and WO2015/092706, the content of which is herein incorporated by reference in their entireties.

"Orthologues" refer to genes from different organisms that have originated through speciation, and may be also derived from a common ancestral gene. It is well-known in the art that paralogues and orthologues may share distinct domains harboring suitable amino acid residues at given sites, such as binding pockets for particular substrates or binding motifs for interaction with other proteins.

In one preferred embodiment, said heterologous polypeptide of interest having PPO-activity is from a prokaryote, preferably bacteria.

More preferably, the prokaryote, preferably bacteria, is of the genus selected from the group consisting of *Escherichia, Rhodothermus, Opitutus, Chloroflexus, Acinetobacter*, and *Bacillus*.

In a particularly preferred embodiment, said polypeptide having PRO activity comprises the sequence of SEQ ID NO: 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 448, 449, 450, 451, 452, 453, 454, 455, 456, 457, 458, 459, 460, 461, 462, 463, 464, 465, 466, 467, 468, 511, 512, 513, 514, 515, 516, 517, 518, 519, 520, 521, 522, 523, 524, 525, 526, 527, 528, 529, 530, 531, 532, 533, 534, 535, or a variant or fragment thereof.

The definitions of "variant" and "fragment", which are given SUPRA in the context of describing the dual transit peptides of the present invention, do likewise apply for said PPO polypeptides of interest.

In a particularly preferred embodiment, the chimeric nucleic acid molecules of the present invention comprises a nucleic acid sequence encoding a polypeptide set forth in SEQ ID NO: 112, 113, 114, 115, 116, 117, 118, 119, 120, 121, 122, 123, 124, 125, 126, 127, 128, 129, 130, 131, 132, 133, 134, 136, 592, 593, 594, 595, 596, 597, 598, 599, 600, 601, 602, 603, 604, 605, 606, 607, 608, 609, 610, 611, 612, 613, 614, 615, 616, 617, 618, 619, 620, 621, 622, 623, or 624, or active variants and fragments thereof.

The recombinant chimeric nucleic acid molecules of the present invention are provided in expression cassettes for expression in the plant of interest.

Thus, in another aspect, the present invention refers to an expression cassette comprising the nucleic acid molecule of the present invention, operably linked to a promoter which drives expression in a plant.

The cassette will include regulatory sequences operably linked to the chimeric nucleic acid molecules of the invention. The term "regulatory element" as used herein refers to a polynucleotide that is capable of regulating the transcription of an operably linked polynucleotide. It includes, but not limited to, promoters, enhancers, introns, 5' UTRs, and 3' UTRs. By "operably linked" is intended a functional linkage between a promoter and a second sequence, wherein the promoter sequence initiates and mediates transcription of the DNA sequence corresponding to the second sequence. Generally, operably linked means that the nucleic acid sequences being linked are contiguous and, where necessary to join two protein coding regions, contiguous and in the same reading frame. The cassette may additionally contain at least one additional gene to be co-transformed into the organism. Alternatively, the additional gene(s) can be provided on multiple expression cassettes. Such an expression cassette is provided with a plurality of restriction sites for insertion of the chimeric nucleic acid molecules to be under the transcriptional regulation of the regulatory regions. The expression cassette may additionally contain selectable marker genes.

The expression cassette of the present invention will include in the 5'-3' direction of transcription, a transcriptional and translational initiation region (i.e., a promoter), a chimeric nucleic acid molecule of the invention, and a transcriptional and translational termination region (i.e., termination region) functional in plants. The promoter may be native or analogous, or foreign or heterologous, to the plant host and/or to the chimeric nucleic acid molecules of the invention. Additionally, the promoter may be the natural sequence or alternatively a synthetic sequence. Where the promoter is "foreign" or "heterologous" to the plant host, it is intended that the promoter is not found in the native plant into which the promoter is introduced. Where the promoter is "foreign" or "heterologous" to the chimeric nucleic acid molecules of the invention, it is intended that the promoter is not the native or naturally occurring promoter for the operably linked chimeric nucleic acid molecules of the invention. As used herein, a chimeric gene comprises a coding sequence operably linked to a transcription initiation region that is heterologous to the coding sequence.

While it may be preferable to express the chimeric nucleic acid molecules of the invention using heterologous promoters, the native promoter sequences may be used. Such constructs would change expression levels of the encoded polypeptide of interest in the plant or plant cell. Thus, the phenotype of the plant or plant cell is altered.

The termination region may be native with the transcriptional initiation region, may be native with the operably linked sequence of interest, may be native with the plant host, or may be derived from another source (i.e., foreign or heterologous to the promoter, the chimeric nucleic acid molecules of interest, the plant host, or any combination thereof). Convenient termination regions are available from the Ti-plasmid of A. tumefaciens, such as the octopine synthase and nopaline synthase termination regions. See also Guerineau et al. (1991) Mol. Gen. Genet. 262: 141-144; Proudfoot (1991) Cell 64:671-674; Sanfacon et al. (1991) Genes Dev. 5: 141-149; Mogen et al. (1990) Plant Cell 2: 1261-1272; Munroe et al. (1990) Gene 91: 151-158; Ballas t al. (1989) Nucleic Acids Res. 17:7891-7903; and Joshi et al. (1987) Nucleic Acid Res. 15:9627-9639. Where appropriate, the gene(s) may be optimized for increased expression in the transformed plant. That is, the genes can be synthesized using plant-preferred codons for improved expression. See, for example, Campbell and Gowri (1990) Plant Physiol. 92: 1-11 for a discussion of host-preferred codon usage. Methods are available in the art for synthesizing plant-preferred genes. See, for example, U.S. Pat. Nos. 5,380,831, and 5,436,391, and Murray et al. (1989) Nucleic Acids Res. 17:477-498, herein incorporated by reference.

Additional sequence modifications are known to enhance gene expression in a cellular host. These include elimination of sequences encoding spurious polyadenylation signals, exon-intron splice site signals, transposon-like repeats, and other such well-characterized sequences that may be deleterious to gene expression. The G-C content of the sequence may be adjusted to levels average for a given cellular host, as calculated by reference to known genes expressed in the host cell. When possible, the sequence is modified to avoid predicted hairpin secondary mRNA structures. Nucleotide sequences for enhancing gene expression can also be used in the plant expression vectors. These include the introns of the maize Adhl, intronl gene (Callis et al. Genes and Development 1: 1183-1200, 1987), and leader sequences, (W-sequence) from the Tobacco Mosaic virus (TMV), Maize Chlorotic Mottle Virus and Alfalfa Mosaic Virus (Gallie et al. Nucleic Acid Res. 15:8693-8711, 1987 and Skuzeski et al. Plant Mol. Biol. 15:65-79, 1990). The first intron from the shrunken-1 locus of maize, has been shown to increase expression of genes in chimeric gene constructs. U.S. Pat. Nos. 5,424,412 and 5,593,874 disclose the use of specific introns in gene expression constructs, and Gallie et al. (Plant Physiol. 106:929-939, 1994) also have shown that introns are useful for regulating gene expression on a tissue specific basis. To further enhance or to optimize chimeric nucleic acid molecule gene expression, the plant expression vectors of the invention may also contain DNA sequences containing matrix attachment regions (MARs). Plant cells transformed with such modified expression systems, then, may exhibit overexpression or constitutive expression of a nucleotide sequence of the invention.

The expression cassettes of the present invention may additionally contain 5' leader sequences in the expression cassette construct. Such leader sequences can act to enhance translation. Translation leaders are known in the art and include: picornavirus leaders, for example, EMCV leader (Encephalomyocarditis 5' noncoding region) (Elroy-Stein et al. (1989) Proc. Natl. Acad. ScL USA 86:6126-6130); potyvirus leaders, for example, TEV leader (Tobacco Etch Virus) (Gallie et al. (1995) Gene 165(2):233-238), MDMV leader (Maize Dwarf Mosaic Virus) (Virology 154:9-20), and human immunoglobulin heavy-chain binding protein (BiP) (Macejak et al. (1991) Nature 353:90-94); untranslated leader from the coat protein mRNA of alfalfa mosaic virus (AMV RNA 4) (Jobling et al. (1987) Nature 325:622-625); tobacco mosaic virus leader (TMV) (Gallie et al. (1989) in Molecular Biology of RNA, ed. Cech (Liss, New York), pp. 237-256); and maize chlorotic mottle virus leader (MCMV) (Lommel et al. (1991) Virology 81:382-385). See also, Della-Cioppa et al. (1987) Plant Physiol, 84:965-968. Other methods known to enhance translation can also be utilized, for example, introns, and the like.

In preparing the expression cassette, the various DNA fragments may be manipulated, so as to provide for the DNA sequences in the proper orientation and, as appropriate, in the proper reading frame. Toward this end, adapters or linkers may be employed to join the DNA fragments or other manipulations may be involved to provide for convenient restriction sites, removal of superfluous DNA, removal of restriction sites, or the like. For this purpose, in vitro mutagenesis, primer repair, restriction, annealing, resubstitutions, e.g., transitions and trans versions, may be involved.

A number of promoters can be used in the practice of the invention. The promoters can be selected based on the desired outcome. The nucleic acids can be combined with constitutive, tissue-preferred, or other promoters for expression in plants. Such constitutive promoters include, for example, the core promoter of the Rsyn7 promoter and other constitutive promoters disclosed in WO 99/43838 and U.S. Pat. No. 6,072,050; the core CaMV 35S promoter (Odell et al. (1985) Nature 313:810-812); rice actin (McElroy et al. (1990) Plant Cell 2: 163-171); ubiquitin (Christensen et al. (1989) Plant Mol. Biol. 12:619-632 and Christensen et al. (1992) Plant Mol. Biol. 18:675-689); pEMU (Last et al. (1991) Theor. Appl. Genet. 81:581-588); MAS (Vetten et al. (1984) EMBO J. 3:2723-2730); ALS promoter (U.S. Pat. No. 5,659,026), and the like. Other constitutive promoters include, for example, U.S. Pat. Nos. 5,608,149; 5,608,144; 5,604,121; 5,569,597; 5,466,785; 5,399,680; 5,268,463; 5,608,142; and 6,177,611.

Tissue-preferred promoters can be utilized to target enhanced chimeric polypeptide expression within a particular plant tissue. Such tissue-preferred promoters include, but are not limited to, leaf-preferred promoters, root-preferred promoters, seed-preferred promoters, and stem-preferred promoters. Tissue-preferred promoters include Yamamoto et al. (1997) Plant J. 12(2):255-265; Kawamata et al. (1997) Plant Cell Physiol. 38(7):792-803; Hansen et al. (1997) Mol. Gen Genet. 254(3):337-343; Russell et al. (1997) Transgenic Res. 6(2): 157-168; Rinehart et al. (1996) Plant Physiol. 112(3): 1331-1341; Van Camp et al. (1996) Plant Physiol. 112(2):525-535; Canevascini et al. (1996) Plant Physiol. 112(2):513-524; Yamamoto et al. (1994) Plant Cell Physiol. 35(5):773-778; Lam (1994) Results Probl. Cell Differ. 20: 181-196; Orozco et al. (1993) Plant Mol Biol. 23(6): 1129-1138; Matsuoka e/[alpha]/. (1993) Proc Natl. Acad. Sci. USA 90(20):9586-9590; and Guevara-Garcia et al. (1993) Plant J. 4(3):495-505. Such promoters can be modified, if necessary, for weak expression.

Methods for transformation of chloroplasts are known in the art. See, for example, Svab et al. (1990) Proc. Natl. Acad. ScL USA 87:8526-8530; Svab and Maliga (1993) Proc. Natl. Acad. Sci. USA 90:913-917; Svab and Maliga (1993) EMBO J. 12:601-606. The method relies on particle gun delivery of DNA containing a selectable marker and targeting of the DNA to the plastid genome through homologous recombination. Additionally, plastid transformation can be accomplished by transactivation of a silent plastid-borne transgene by tissue-preferred expression of a nuclear-encoded and plastid-directed RNA polymerase. Such a system has been reported in. McBride et al. (1994) Proc. Natl. Acad. Sci. USA 91:7301-7305. The nucleic acids of interest to be targeted to the chloroplast may be optimized for expression in the chloroplast to account for differences in codon usage between the plant nucleus and this organelle. In this manner, the nucleic acids of interest may be synthesized using chloroplast-preferred codons. See, for example, U.S. Pat. No. 5,380,831, herein incorporated by reference.

The expression cassettes of the invention can include another selectable marker gene for the selection of transformed cells. Selectable marker genes, including those of the present invention, are utilized for the selection of transformed cells or tissues. Marker genes include, but are not limited to, genes encoding antibiotic resistance, such as those encoding neomycin phosphotransferase II (NEO) and hygromycin phosphotransferase (HPT), as well as genes conferring resistance to herbicidal compounds, such as glufosinate ammonium, bromoxynil, imidazolinones, and 2,4-dichlorophenoxyacetate (2,4-D). See generally, Yarranton (1992) Curr. Opin. Biotech. 3:506-511; Christophers on et al (1992) Proc. Natl. Acad. ScL USA 89:6314-6318; Yao et al. (1992) Cell 71:63-72; Reznikoff (1992) Mol Microbial 6:2419-2422; Barkley et al (1980) in The Operon, pp. 177-220; Hu et al (1987) Cell 48:555-566; Brown et al (1987) Cell 49:603-612; Figge et al (1988) Cell 52:713-722; Deuschle et al (1989) Proc. Natl Acad. AcL USA 86:5400-5404; Fuerst et al (1989) Proc. Natl. Acad. ScL USA 86:2549-2553; Deuschle et al (1990) Science 248:480-483; Gossen (1993) Ph.D. Thesis, University of Heidelberg; Reines et al (1993) Proc. Natl Acad. ScL USA 90: 1917-1921; Labow et al (1990) Mol Cell Biol 10:3343-3356; Zambretti et al (1992) Proc. Natl Acad. ScL USA 89:3952-3956; Bairn et al (1991) Proc. Natl. Acad. ScL USA, 88:5072-5076; Wyborski et al (1991) Nucleic Acids Res. 19:4647-4653; Hillenand-Wissman (1989) Topics Mol Struc. Biol 10: 143-162; Degenkolb et al (1991) Antimicrob. Agents Chemother. 35: 1591-1595; Kleinschnidt et al (1988) Biochemistry 27: 1094-1104; Bonin (1993) Ph.D. Thesis, University of Heidelberg; Gossen et al (1992) Proc. Natl Acad, ScL USA 89:5547-5551; Oliva et al (1992) Antimicrob. Agents Chemother. 36:913-919; Hlavka et al (1985) Handbook of Experimental Pharmacology, Vol. 78 (Springer-Verlag, Berlin); Gill et al (1988) Nature 334:721-724. Such disclosures are herein incorporated by reference. The above list of selectable marker genes is not meant to be limiting. Any selectable marker gene can be used in the present invention.

The invention further provides an isolated recombinant expression vector comprising the expression cassette containing a chimeric polypeptide nucleic acid as described above, wherein expression of the vector in a host cell results in increased tolerance to a PPO-inhibiting herbicide as compared to a wild type variety of the host cell. As used herein, the term "vector" refers to a nucleic acid molecule capable of transporting another nucleic acid to which it has been linked. One type of vector is a "plasmid," which refers to a circular double stranded DNA loop into which additional DNA segments can be ligated. Another type of vector is a viral vector, wherein additional DNA segments can be ligated into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively linked. Such vectors are referred to herein as "expression vectors." In general, expression vectors of utility in recombinant DNA techniques are often in the form of plasmids. In the present specification, "plasmid" and "vector" can be used interchangeably as the plasmid is the most commonly used form of vector. However, the invention is intended to include such other forms of expression vectors, such as viral vectors (e.g., replication defective retroviruses, adenoviruses, and adeno-associated viruses), which serve equivalent functions.

The recombinant expression vectors of the invention comprise a nucleic acid of the invention in a form suitable for expression of the nucleic acid in a host cell, which means that the recombinant expression vectors include one or more regulatory sequences, selected on the basis of the host cells to be used for expression, which is operably linked to the nucleic acid sequence to be expressed. Regulatory sequences include those that direct constitutive expression of a nucleotide sequence in many types of host cells and those that direct expression of the nucleotide sequence only in certain host cells or under certain conditions. It will be appreciated by those skilled in the art that the design of the expression vector can depend on such factors as the choice of the host cell to be transformed, the level of expression of polypeptide desired, etc. The expression vectors of the invention can be introduced into host cells to thereby produce polypeptides or peptides, including fusion polypeptides or peptides, encoded by nucleic acids as described herein (e.g., chimeric polypeptides, fusion polypeptides, etc.).

In a preferred embodiment of the present invention, the chimeric polypeptides are expressed in plants and plants cells such as unicellular plant cells (such as algae) (See Falciatore et al., 1999, Marine Biotechnology 1(3):239-251 and references therein) and plant cells from higher plants (e.g., the spermatophytes, such as crop plants). A chimeric polynucleotide may be "introduced" into a plant cell by any means, including transfection, transformation or transduction, electroporation, particle bombardment, agroinfection, biolistics, and the like.

Suitable methods for transforming or transfecting host cells including plant cells can be found in Sambrook et al. (Molecular Cloning: A Laboratory Manual. 2nd, ed., Cold Spring Harbor Laboratory, Cold Spring Harbor Laboratory Press, Cold Spring Harbor, N.Y., 1989) and other laboratory manuals such as Methods in Molecular Biology, 1995, Vol. 44, *Agrobacterium* protocols, ed: Gartland and Davey, Humana Press, Totowa, N.J. As increased tolerance to PPO-inhibiting herbicides is a general trait wished to be inherited into a wide variety of plants like maize, wheat, rye, oat, triticale, rice, barley, soybean, peanut, cotton, rapeseed and *canola*, manihot, pepper, sunflower and *Tagetes*, solanaceous plants like potato, tobacco, eggplant, and tomato, *vicia* species, pea, alfalfa, bushy plants (coffee, cacao, tea), *Salix* species, trees (oil palm, coconut), perennial grasses, and forage crops, these crop plants are also preferred target plants for a genetic engineering as one further embodiment of the present invention. In a preferred embodiment, the plant is a crop plant. Forage crops include, but are not limited to, Wheatgrass, Canarygrass, Bromegrass, Wildrye Grass, Bluegrass, Orchardgrass, Alfalfa, Salfoin, Birdsfoot Trefoil, Alsike Clover, Red Clover, and Sweet Clover.

In one embodiment of the present invention, transfection of a chimeric polynucleotide into a plant is achieved by *Agrobacterium* mediated gene transfer. One transformation method known to those of skill in the art is the dipping of a flowering plant into an Agrobacteria solution, wherein the Agrobacteria contains the chimeric polypeptide nucleic acid, followed by breeding of the transformed gametes. *Agrobacterium* mediated plant transformation can be performed using for example the GV3101(pMP90) (Koncz and Schell, 1986, Mol. Gen. Genet. 204:383-396) or LBA4404 (Clontech) *Agrobacterium tumefaciens* strain. Transformation can be performed by standard transformation and regeneration techniques (Deblaere et al., 1994, Nucl. Acids. Res. 13:4777-4788; Gelvin, Stanton B. and Schilperoort, Robert A, Plant Molecular Biology Manual, 2nd Ed. —Dordrecht Kluwer Academic Publ., 1995. —in Sect., Ringbuc Zentrale Signatur: BT11-P ISBN 0-7923-2731-4; Glick, Bernard R. and Thompson, John E., Methods in Plant Molecular Biology and Biotechnology, Boca Raton: CRC Press, 1993 360 S., ISBN 0-8493-5164-2). For example, rapeseed can be transformed via cotyledon or hypocotyl transformation (Moloney et al., 1989, Plant Cell Report 8:238-242; De Block et al., 1989, Plant. Physiol. 91:694-701). Use of antibiotics for *Agrobacterium* and plant selection depends on the binary vector and the *Agrobacterium* strain used for transformation. Rapeseed selection is normally performed using kanamycin as selectable plant marker. *Agrobacterium* mediated gene transfer to flax can be performed using, for example, a technique described by Mlynarova et al., 1994, Plant Cell Report 13:282-285. Additionally, transformation of soybean can be performed using for example a technique described in European Patent No. 0424 047, U.S. Pat. No. 5,322,783, European Patent No. 0397 687, U.S. Pat. No. 5,376,543, or 5,169,770. Transformation of maize can be achieved by particle bombardment, polyethylene glycol mediated DNA uptake, or via the silicon carbide fiber technique. (See, for example, Freeling and Walbot "The maize handbook" Springer Verlag: New York (1993) ISBN 3-540-97826-7). A specific example of maize transformation is found in U.S. Pat. No. 5,990,387, and a specific example of wheat transformation can be found in PCT Application No. WO 93/07256.

According to the present invention, the introduced chimeric polynucleotide may be maintained in the plant cell stably if it is incorporated into a non-chromosomal autonomous replicon or integrated into the plant chromosomes. Alternatively, the introduced chimeric polynucleotide may be present on an extra-chromosomal non-replicating vector and be transiently expressed or transiently active.

In the homologous recombination vector, the chimeric polynucleotide can be flanked at its 5' and 3' ends by an additional nucleic acid molecule to allow for homologous recombination to occur between the exogenous chimeric polynucleotide carried by the vector and an endogenous gene, in a microorganism or plant. The additional flanking chimeric nucleic acid molecule molecule is of sufficient length for successful homologous recombination with the endogenous gene. Typically, several hundreds of base pairs up to kilobases of flanking DNA (both at the 5' and 3' ends) are included in the vector (see e.g., Thomas, K. R., and Capecchi, M. R., 1987, Cell 51:503 for a description of homologous recombination vectors or Strepp et al., 1998, PNAS, 95(8):4368-4373 for cDNA based recombination in *Physcomitrella patens*). However, since the chimeric polynucleotide normally differs from the PPO gene at very few amino acids, a flanking sequence is not always necessary. The homologous recombination vector is introduced into a microorganism or plant cell (e.g., via polyethylene glycol mediated DNA), and cells in which the introduced chimeric polynucleotide has homologously recombined with the endogenous gene are selected using art-known techniques.

In another embodiment, recombinant microorganisms can be produced that contain selected systems that allow for regulated expression of the introduced gene. For example, inclusion of a chimeric polynucleotide on a vector placing it under control of the lac operon permits expression of the chimeric polynucleotide only in the presence of IPTG. Such regulatory systems are well known in the art.

Another aspect of the invention pertains to host cells into which a recombinant expression vector of the invention has been introduced. The terms "host cell" and "recombinant host cell" are used interchangeably herein. It is understood that such terms refer not only to the particular subject cell but they also apply to the progeny or potential progeny of such a cell. Because certain modifications may occur in succeeding generations due to either mutation or environmental influences, such progeny may not, in fact, be identical to the parent cell, but are still included within the scope of the term as used herein. A host cell can be any prokaryotic or eukaryotic cell. For example, a chimeric polynucleotide can be expressed in bacterial cells such as *C. glutamicum*, insect cells, fungal cells, or mammalian cells (such as Chinese hamster ovary cells (CHO) or COS cells), algae, ciliates, plant cells, fungi or other microorganisms like *C. glutamicum*. Other suitable host cells are known to those skilled in the art.

A host cell of the invention, such as a prokaryotic or eukaryotic host cell in culture, can be used to produce (i.e., express) a chimeric polynucleotide. Accordingly, the invention further provides methods for producing chimeric polypeptides using the host cells of the invention. In one embodiment, the method comprises culturing the host cell of invention (into which a recombinant expression vector encoding a chimeric polypeptide has been introduced, or into which genome has been introduced a gene encoding a wild-type or chimeric polypeptide) in a suitable medium until chimeric polypeptide is produced. In another embodiment, the method further comprises isolating chimeric polypeptides from the medium or the host cell. Another aspect of the invention pertains to isolated chimeric polypeptides, and biologically active portions thereof. An "isolated" or "purified" polypeptide or biologically active portion thereof is free of some of the cellular material when produced by recombinant DNA techniques, or chemical precursors or other chemicals when chemically synthesized. The language "substantially free of cellular material" includes preparations of chimeric polypeptide in which the polypeptide is separated from some of the cellular components of the cells in which it is naturally or recombinantly produced. In one embodiment, the language "substantially free of cellular material" includes preparations of a chimeric polypeptide having less than about 30% (by dry weight) of non-chimeric polypeptide material (also referred to herein as a "contaminating polypeptide"), more preferably less than about 20% of non-chimeric polypeptide material, still more preferably less than about 10% of non-chimeric polypeptide material, and most preferably less than about 5% non-chimeric polypeptide material.

When the chimeric polypeptide, or biologically active portion thereof, is recombinantly produced, it is also preferably substantially free of culture medium, i.e., culture medium represents less than about 20%, more preferably less than about 10%, and most preferably less than about 5% of the volume of the polypeptide preparation. The language "substantially free of chemical precursors or other chemicals" includes preparations of chimeric polypeptide in which the polypeptide is separated from chemical precursors or other chemicals that are involved in the synthesis of the polypeptide. In preferred embodiments, isolated polypeptides, or biologically active portions thereof, lack contaminating polypeptides from the same organism from which the chimeric polypeptide is derived. Typically, such polypeptides are produced by recombinant expression of, for example, a chimeric polypeptide in plants other than, or in microorganisms such as *C. glutamicum*, ciliates, algae, or fungi.

In another aspect, the present invention refers to a plant cell comprising the expression cassette of the present invention. Preferably, the expression cassette comprises a chimeric nucleic acid molecule comprising (a) the sequence of SEQ ID NO: 99, 100, 101, 102, 103, 104, 105, 106, 107, 108, 109, 110, 111, or 135, or a fragment or variant as defined herein thereof, (b) a polynucleotide comprising at least 60 consecutive nucleotides of any of a); and c) a polynucleotide complementary to the polynucleotide of any of a) through b).

In another preferred embodiment, the expression cassette of said plant cell comprises a chimeric nucleic acid molecule encoding a polypeptide set forth in SEQ ID NO: 112, 113, 114, 115, 116, 117, 118, 119, 120, 121, 122, 123, 124, 125, 126, 127, 128, 129, 130, 131, 132, 133, 134, 136, 592, 593, 594, 595, 596, 597, 598, 599, 600, 601, 602, 603, 604, 605, 606, 607, 608, 609, 610, 611, 612, 613, 614, 615, 616, 617, 618, 619, 620, 621, 622, 623, or 624, or active variants and fragments thereof.

Preferably, the expression of the chimeric nucleic acid molecule of the invention in the plant cell results in increased resistance or tolerance to a herbicide as compared to a wild type variety of the plant cell.

In another aspect, the present invention refers to a plant or plant part comprising a plant cell of the present invention.

In specific embodiments, the plants and/or plant parts have stably incorporated at least one of the chimeric nucleic acid molecules of the present invention or a variant or fragment thereof.

Thus, plants, plant cells, plant parts and seed are provided which comprise at least one polynucleotide comprising a dual transit peptide—encoding sequence operably linked to a heterologous polynucleotide encoding a polypeptide of interest, wherein the dual transit peptide comprises any one of SEQ ID NOs: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, or variants and fragments thereof.

Further provided are plants, plant cells and seeds comprising the chimeric nucleic acid molecules having the sequences as set forth in SEQ ID NO: 99, 100, 101, 102, 103, 104, 105, 106, 107, 108, 109, 110, 111, or 135.

Further provided are plants, plant cells and seeds comprising chimeric nucleic acid molecules encoding a polypeptide set forth in SEQ ID NO: 112, 113, 114, 115, 116, 117, 118, 119, 120, 121, 122, 123, 124, 125, 126, 127, 128, 129, 130, 131, 132, 133, 134, 136, 592, 593, 594, 595, 596, 597, 598, 599, 600, 601, 602, 603, 604, 605, 606, 607, 608, 609, 610, 611, 612, 613, 614, 615, 616, 617, 618, 619, 620, 621, 622, 623, or 624, or active variants and fragments thereof.

The term "plant" is used in its broadest sense as it pertains to organic material and is intended to encompass eukaryotic organisms that are members of the Kingdom Plantae, examples of which include but are not limited to vascular plants, vegetables, grains, flowers, trees, herbs, bushes, grasses, vines, ferns, mosses, fungi and algae, etc, as well as clones, offsets, and parts of plants used for asexual propagation (e.g. cuttings, pipings, shoots, rhizomes, underground stems, clumps, crowns, bulbs, corms, tubers, rhizomes, plants/tissues produced in tissue culture, etc.). The term "plant" further encompasses whole plants, ancestors and progeny of the plants and plant parts, including seeds, shoots, stems, leaves, roots (including tubers), flowers, florets, fruits, pedicles, peduncles, stamen, anther, stigma, style, ovary, petal, sepal, carpel, root tip, root cap, root hair, leaf hair, seed hair, pollen grain, microspore, cotyledon, hypocotyl, epicotyl, xylem, phloem, parenchyma, endosperm, a companion cell, a guard cell, and any other known organs, tissues, and cells of a plant, and tissues and organs, wherein each of the aforementioned comprise the gene/nucleic acid of interest. The term "plant" also encompasses plant cells, suspension cultures, callus tissue, embryos, meristematic regions, gametophytes, sporophytes, pollen and microspores, again wherein each of the aforementioned comprises the gene/nucleic acid of interest.

Plants of the invention include all plants which belong to the superfamily Viridiplantae, in particular monocotyledonous and dicotyledonous plants including fodder or forage legumes, ornamental plants, food crops, trees or shrubs selected from the list comprising *Acer* spp., *Actinidia* spp., *Abelmoschus* spp., *Agave sisalana, Agropyron* spp., *Agrostis stolonifera, Allium* spp., *Amaranthus* spp., *Ammophila arenaria, Ananas comosus, Annona* spp., *Apium graveolens, Arachis* spp, *Artocarpus* spp., *Asparagus officinalis, Avena* spp. (e.g. *Avena sativa, Avena fatua, Avena byzantina, Avena fatua* var. *sativa, Avena hybrids*), *Averrhoa carambola, Bambusa* sp., *Benincasa hispida, Bertholletia excelsea, Beta vulgaris, Brassica* spp. (e.g. *Brassica napus, Brassica rapa* ssp. [*canola*, oilseed rape, turnip rape]), *Cadaba farinosa, Camellia sinensis, Canna indica, Cannabis sativa, Capsicum* spp., *Carex elata, Carica papaya, Carissa macrocarpa, Carya* spp., *Carthamus tinctorius, Castanea* spp., *Ceiba pentandra, Cichorium endivia, Cinnamomum* spp., *Citrullus lanatus, Citrus* spp., *Cocos* spp., *Coffea* spp., *Colocasia esculenta, Cola* spp., *Corchorus* sp., *Coriandrum sativum, Corylus* spp., *Crataegus* spp., *Crocus sativus, Cucurbita* spp., *Cucumis* spp., *Cynara* spp., *Daucus carota, Desmodium* spp., *Dimocarpus Iongan, Dioscorea* spp., *Diospyros* spp., *Echinochloa* spp., *Elaeis* (e.g. *Elaeis guineensis, Elaeis oleifera*), *Eleusine coracana, Eragrostis tef, Erianthus* sp., *Eriobotrya japonica, Eucalyptus* sp., *Eugenia uniflora, Fagopyrum* spp., *Fagus* spp., *Festuca arundinacea, Ficus carica, Fortunella* spp., *Fragaria* spp., *Ginkgo biloba, Glycine* spp. (e.g. *Glycine max, Soja hispida* or *Soja max*), *Gossypium hirsutum, Helianthus* spp. (e.g. *Helianthus annuus*), *Hemerocallis fulva, Hibiscus* spp., *Hordeum* spp. (e.g. *Hordeum vulgare*), *Ipomoea batatas, Juglans* spp., *Lactuca sativa, Lathyrus* spp., *Lens culinaris, Linum usitatissimum, Litchi chinensis, Lotus* spp., *Luffa acutangula, Lupinus* spp., *Luzula sylvatica, Lycopersicon* spp. (e.g. *Lycopersicon esculentum, Lycopersicon lycopersicum, Lycopersicon pyriforme*), *Macrotyloma* spp., *Malus* spp., *Malpighia emarginata, Mammea americana, Mangifera indica, Manihot* spp., *Manilkara zapota, Medicago sativa, Melilotus* spp., *Mentha* spp., *Miscanthus sinensis, Momordica* spp., *Morus nigra, Musa* spp., *Nicotiana* spp., *Olea* spp., *Opuntia* spp., *Ornithopus* spp., *Oryza* spp. (e.g. *Oryza sativa, Oryza latifolia*), *Panicum miliaceum, Panicum virgaturn, Passiflora edulis, Pastinaca sativa, Pennisetum* sp., *Persea* spp., *Petroselinum crispum, Phalaris arundinacea, Phaseolus* spp., *Phleum pratense, Phoenix* spp., *Phragmites australis, Physalis* spp., *Pinus* spp., *Pistacia vera, Pisum* spp., *Poa* spp., *Populus* spp., *Prosopis* spp., *Prunus* spp., *Psidium* spp., *Punica granatum, Pyrus communis, Quercus* spp., *Raphanus sativus, Rheum rhabarbarum, Ribes* spp., *Ricinus communis, Rubus* spp., *Saccharum* spp., *Salix* sp., *Sambucus* spp., *Secale cereale, Sesamum* spp., *Sinapis* sp., *Solanum* spp. (e.g. *Solanum tuberosum, Solanum integrifolium* or *Solanum lycopersicum*), *Sorghum bicolor, Spinacia* spp., *Syzygium* spp., *Tagetes* spp., *Tamarindus indica, Theobroma cacao, Trifolium* spp., *Tripsacum dactyloides, Triticosecale rimpaui, Triticum* spp. (e.g. *Triticum aestivum, Triticum durum, Triticum turgidum, Triticum hybernum, Triticum macha, Triticum sativum, Triticum monococcum* or *Triticum vulgare*), *Tropaeolum minus, Tropaeolum majus, Vaccinium* spp., *Vicia* spp., *Vigna* spp., *Viola odorata, Vitis* spp., *Zea mays, Zizania palustris, Ziziphus* spp., amaranth, artichoke, *asparagus*, broccoli, Brussels sprouts, cabbage, *canola*, carrot, cauliflower, celery, collard greens, flax, kale, lentil, oilseed rape, okra, onion, potato, rice, soybean, strawberry, sugar beet, sugar cane, sunflower, tomato, squash, tea and algae, amongst others. According to a preferred embodiment of the present invention, the plant is a crop plant. Examples of crop plants include inter alia soybean, sunflower, *canola*, alfalfa, rapeseed, cotton, tomato, potato or tobacco. Further preferebly, the plant is a monocotyledonous plant, such as sugarcane. Further preferably, the plant is a cereal, such as rice, maize, wheat, barley, millet, rye, *sorghum* or oats.

In another aspect, the present invention refers to a seed derived from a plant of the present invention.

In another aspect, the present invention refers to a method for expressing a nucleic acid encoding a polypeptide of interest in a plant comprising (a) introducing into a plant cell the nucleic acid molecule of the present invention or the expression cassette of the present invention, and (b) regenerating a plant therefrom that comprises the the nucleic acid molecule of the present invention or the expression cassette of the present invention.

The term "expression/expressing" or "gene expression" means the transcription of a specific gene or specific genes or specific genetic construct. The term "expression" or "gene expression" in particular means the transcription of a gene or genes or genetic construct into structural RNA (rRNA, tRNA) or mRNA with or without subsequent translation of the latter into a protein. The process includes transcription of DNA and processing of the resulting mRNA product.

To obtain the desired effect, e.g. plants that are tolerant or resistant to herbicides, it will be understood that the at least one nucleic acid is "over-expressed" by methods and means known to the person skilled in the art.

The term "increased expression" or "overexpression" as used herein means any form of expression that is additional to the original wild-type expression level. Methods for increasing expression of genes or gene products are well documented in the art and include, for example, overexpression driven by appropriate promoters, the use of transcription enhancers or translation enhancers. Isolated nucleic acids which serve as promoter or enhancer elements may be introduced in an appropriate position (typically upstream) of a non-heterologous form of a polynucleotide so as to upregulate expression of a nucleic acid encoding the polypeptide of interest. For example, endogenous promoters may be altered in vivo by mutation, deletion, and/or substitution (see, Kmiec, U.S. Pat. No. 5,565,350; Zarling et al., WO9322443), or isolated promoters may be introduced into a plant cell in the proper orientation and distance from a gene of the present invention so as to control the expression of the gene.

If polypeptide expression is desired, it is generally desirable to include a polyadenylation region at the 3'-end of a polynucleotide coding region. The polyadenylation region can be derived from the natural gene, from a variety of other plant genes, or from T-DNA. The 3' end sequence to be added may be derived from, for example, the nopaline synthase or octopine synthase genes, or alternatively from another plant gene, or less preferably from any other eukaryotic gene.

An intron sequence may also be added to the 5' untranslated region (UTR) or the coding sequence of the partial coding sequence to increase the amount of the mature message that accumulates in the cytosol. Inclusion of a spliceable intron in the transcription unit in both plant and animal expression constructs has been shown to increase gene expression at both the mRNA and protein levels up to 1000-fold (Buchman and Berg (1988) Mol. Cell biol. 8: 4395-4405; Callis et al. (1987) Genes Dev 1:1183-1200). Such intron enhancement of gene expression is typically greatest when placed near the 5' end of the transcription unit. Use of the maize introns Adh1-S intron 1, 2, and 6, the Bronze-1 intron are known in the art. For general information see: The Maize Handbook, Chapter 116, Freeling and Walbot, Eds., Springer, N.Y. (1994)

The terms "introduction" or "transformation" as referred to herein encompass the transfer of an exogenous polynucleotide into a host cell, irrespective of the method used for transfer. Plant tissue capable of subsequent clonal propagation, whether by organogenesis or embryogenesis, may be transformed with a genetic construct of the present invention and a whole plant regenerated there from. The particular tissue chosen will vary depending on the clonal propagation systems available for, and best suited to, the particular species being transformed. Exemplary tissue targets include leaf disks, pollen, embryos, cotyledons, hypocotyls, megagametophytes, callus tissue, existing meristematic tissue (e.g., apical meristem, axillary buds, and root meristems), and induced meristem tissue (e.g., cotyledon meristem and hypocotyl meristem). The polynucleotide may be transiently or stably introduced into a host cell and may be maintained non-integrated, for example, as a plasmid. Alternatively, it may be integrated into the host genome. The resulting transformed plant cell may then be used to regenerate a transformed plant in a manner known to persons skilled in the art.

The transfer of foreign genes into the genome of a plant is called transformation. Transformation of plant species is now a fairly routine technique. Advantageously, any of several transformation methods may be used to introduce the gene of interest into a suitable ancestor cell. The methods described for the transformation and regeneration of plants from plant tissues or plant cells may be utilized for transient or for stable transformation. Transformation methods include the use of liposomes, electroporation, chemicals that increase free DNA uptake, injection of the DNA directly into the plant, particle gun bombardment, or transformation using viruses or pollen and microprojection. Methods may be selected from the calcium/polyethylene glycol method for protoplasts (Krens, F. A. et al., (1982) Nature 296, 72-74; Negrutiu I et al. (1987) Plant Mol Biol 8: 363-373); electroporation of protoplasts (Shillito R. D. et al. (1985) Bio/Technol 3, 1099-1102); microinjection into plant material (Crossway A et al., (1986) Mol. Gen Genet 202: 179-185); DNA or RNA-coated particle bombardment (Klein T M et al., (1987) Nature 327: 70) infection with (non-integrative) viruses and the like. Transgenic plants, including transgenic crop plants, are preferably produced via *Agrobacterium*-mediated transformation. An advantageous transformation method is the transformation in planta. To this end, it is possible, for example, to allow the agrobacteria to act on plant seeds or to inoculate the plant meristem with agrobacteria. It has proved particularly expedient in accordance with the invention to allow a suspension of transformed agrobacteria to act on the intact plant or at least on the flower primordia. The plant is subsequently grown on until the seeds of the treated plant are obtained (Clough and Bent, Plant J. (1998) 16, 735-743). Methods for *Agrobacterium*-mediated transformation of rice include well known methods for rice transformation, such as those described in any of the following: European patent application EP 1198985 A1, Aldemita and Hodges (Planta 199: 612-617, 1996); Chan et al. (Plant Mol Biol 22 (3): 491-506, 1993), Hiei et al. (Plant J 6 (2): 271-282, 1994), which disclosures are incorporated by reference herein as if fully set forth. In the case of corn transformation, the preferred method is as described in either Ishida et al. (Nat. Biotechnol 14(6): 745-50, 1996) or Frame et al. (Plant Physiol 129(1): 13-22, 2002), which disclosures are incorporated by reference herein as if fully set forth. Said methods are further described by way of example in B. Jenes et al., Techniques for Gene Transfer, in: Transgenic Plants, Vol. 1, Engineering and Utilization, eds. S. D. Kung and R. Wu, Academic Press (1993) 128-143 and in Potrykus Annu. Rev. Plant Physiol. Plant. Molec. Biol. 42 (1991) 205-225). The nucleic acids or the construct to be expressed is preferably cloned into a vector, which is suitable for transforming *Agrobacterium tumefaciens*, for example pBin 19 (Bevan et al., Nucl. Acids Res. 12 (1984) 8711). Agrobacteria transformed by such a vector can then be used in known manner for the transformation of plants, such as plants used as a model, like *Arabidopsis* (*Arabidopsis thaliana* is within the scope of the present invention not considered as a crop plant), or crop plants such as, by way of example, tobacco plants, for example by immersing bruised leaves or chopped leaves in an agrobacterial solution and then culturing them in suitable media. The transformation of plants by means of *Agrobacterium tumefaciens* is described, for example, by Höfgen and Willmitzer in Nuci. Acid Res. (1988) 16, 9877 or is known inter alia from F. F. White, Vectors for Gene Transfer in Higher Plants; in Transgenic Plants, Vol. 1, Engineering and Utilization, eds. S. D. Kung and R. Wu, Academic Press, 1993, pp. 15-38.

In addition to the transformation of somatic cells, which then have to be regenerated into intact plants, it is also possible to transform the cells of plant meristems and in particular those cells which develop into gametes. In this case, the transformed gametes follow the natural plant development, giving rise to transgenic plants. Thus, for example, seeds of *Arabidopsis* are treated with agrobacteria and seeds are obtained from the developing plants of which a certain proportion is transformed and thus transgenic [Feldman, K A and Marks M D (1987). Mol Gen Genet 208:274-289; Feldmann. K (1992). In: C Koncz, N-H Chua and J Shell, eds, Methods in *Arabidopsis* Research. Word Scientific, Singapore, pp. 274-289]. Alternative methods are based on the repeated removal of the inflorescences and incubation of the excision site in the center of the rosette with transformed agrobacteria, whereby transformed seeds can likewise be obtained at a later point in time (Chang (1994). Plant J. 5: 551-558; Katavic (1994). Mol Gen Genet, 245: 363-370). However, an especially effective method is the vacuum infiltration method with its modifications such as the "floral dip" method. In the case of vacuum infiltration of *Arabidopsis*, intact plants under reduced pressure are treated with an agrobacterial suspension [Bechthold, N (1993). C R Aced Sci Paris Life Sci, 316: 1194-1199], while in the case of the "floral dip" method the developing floral tissue is incubated briefly with a surfactant-treated agrobacterial suspension [Clough, S J and Bent A F (1998) The Plant J. 16, 735-743]. A certain proportion of transgenic seeds are harvested in both cases, and these seeds can be distinguished from non-transgenic seeds by growing under the above-described selective conditions. In addition the stable transformation of plastids is of advantages because plastids are inherited maternally is most crops reducing or eliminating the risk of transgene flow through pollen. The transformation of the chloroplast genome is generally achieved by a process which has been schematically displayed in Klaus et al., 2004 [Nature Biotechnology 22 (2), 225-229]. Briefly the sequences to be transformed are cloned together with a selectable marker gene between flanking sequences homologous to the chloroplast genome. These homologous flanking sequences direct site specific integration into the plastome. Plastidal transformation has been described for many different plant species and an overview is given in Bock (2001) Transgenic plastids in basic research and plant biotechnology. J Mol Biol. 2001 Sep. 21; 312 (3):425-38 or Maliga, P (2003) Progress towards commercialization of plastid transformation technology. Trends Biotechnol. 21, 20-28. Further biotechnological progress has recently been reported in form of marker free plastid transformants, which can be produced by a transient co-integrated maker gene (Klaus et al., 2004, Nature Biotechnology 22(2), 225-229). The genetically modified plant cells can be regenerated via all methods with which the skilled worker is familiar. Suitable methods can be found in the abovementioned publications by S. D. Kung and R. Wu, Potrykus or Höfgen and Willmitzer.

Generally after transformation, plant cells or cell groupings are selected for the presence of one or more markers which are encoded by plant-expressible genes co-transferred with the gene of interest, following which the transformed material is regenerated into a whole plant. To select transformed plants, the plant material obtained in the transformation is, as a rule, subjected to selective conditions so that transformed plants can be distinguished from untransformed plants. For example, the seeds obtained in the above-described manner can be planted and, after an initial growing period, subjected to a suitable selection by spraying. A further possibility consists in growing the seeds, if appropriate after sterilization, on agar plates using a suitable selection agent so that only the transformed seeds can grow into plants. Alternatively, the transformed plants are screened for the presence of a selectable marker such as the ones described above.

Following DNA transfer and regeneration, putatively transformed plants may also be evaluated, for instance using Southern analysis, for the presence of the gene of interest, copy number and/or genomic organisation. Alternatively or additionally, expression levels of the newly introduced DNA may be monitored using Northern and/or Western analysis, both techniques being well known to persons having ordinary skill in the art.

The generated transformed plants may be propagated by a variety of means, such as by clonal propagation or classical breeding techniques. For example, a first generation (or T1) transformed plant may be selfed and homozygous second-generation (or T2) transformants selected, and the T2 plants may then further be propagated through classical breeding techniques. The generated transformed organisms may take a variety of forms. For example, they may be chimeras of transformed cells and non-transformed cells; clonal transformants (e.g., all cells transformed to contain the expression cassette); grafts of transformed and untransformed tissues (e.g., in plants, a transformed rootstock grafted to an untransformed scion).

In another aspect, the present invention refers to a method for producing a herbicide tolerant plant comprising (a) introducing into a plant cell the nucleic acid molecule of the present invention or the expression cassette of the present invention, and (b) regenerating a plant therefrom that comprises the the nucleic acid molecule of the present invention or the expression cassette of the present invention.

In another aspect, the present invention refers to a method for controlling undesired vegetation at a plant cultivation site, the method comprising the steps of:

c) Providing at that site a herbicide tolerant plant that comprises the nucleic acid molecule of the present invention or the expression cassette of the present invention d) Applying to that site an effective amount of a herbicide, wherein the effective amount of said herbicide does not kill or inhibit the growth of the herbicide-tolerant plant of a).

The term "control of undesired vegetation" is to be understood as meaning the killing of weeds and/or otherwise retarding or inhibiting the normal growth of the weeds. Weeds, in the broadest sense, are understood as meaning all those plants which grow in locations where they are undesired, e.g. (crop) plant cultivation sites. The weeds of the present invention include, for example, dicotyledonous and monocotyledonous weeds. Dicotyledonous weeds include, but are not limited to, weeds of the genera: *Sinapis, Lepidium, Galium, Stellaria, Matricaria, Anthemis, Galinsoga, Chenopodium, Urtica, Senecio, Arnaranthus, Portulaca, Xanthium, Convolvulus, Ipomoea, Polygonum, Sesbania, Ambrosia, Cirsium, Carduus, Sonchus, Solanum, Rorippa, Rotala, Lindernia, Lamium, Veronica, Abutilon, Emex, Datura, Viola, Galeopsis, Papaver, Centaurea, Trifolium, Ranunculus*, and *Taraxacum*. Monocotyledonous weeds include, but are not limited to, weeds of of the genera: *Echinochloa, Setaria, Panicum, Digitaria, Phleum, Poe, Festuca, Eleusine, Brachiaria, Lolium, Bromus, Avena, Cyperus, Sorghum, Agropyron, Cynodon, Monochoria, Fimbristyslis, Sagittaria, Eleocharis, Scirpus, Paspalum, Ischaemum, Sphenoclea, Dactyloctenium, Agrostis, Alopecurus*, and *Apera*. In addition, the weeds of the present invention can include, for example, crop plants that are growing in an undesired location. For example, a volunteer maize plant that is in a field that predominantly comprises soybean plants can be considered a weed, if the maize plant is undesired in the field of soybean plants.

Additionally, in certain embodiments, the chimeric nucleic acid molecules of the present invention can be stacked with any combination of polynucleotide sequences of interest in order to create plants with a desired phenotype. For example, the nucleic acids of the present invention may be stacked with any other polynucleotides encoding polypeptides having pesticidal and/or insecticidal activity, such as, for example, the *Bacillus thuringiensis* toxin proteins (described in U.S. Pat. Nos. 5,366,892; 5,747,450; 5,737,514; 5,723,756; 5,593,881; and Geiser et al (1986) Gene 48: 109), By way of example, polynucleotides that may be stacked with the chimeric nucleic acid molecules of the present invention include nucleic acids encoding polypeptides conferring resistance to pests/pathogens such as viruses, nematodes, insects or fungi, and the like. Exemplary polynucleotides that may be stacked with nucleic acids of the invention include polynucleotides encoding: polypeptides having pesticidal and/or insecticidal activity, such as other *Bacillus thuringiensis* toxic proteins (described in U.S. Pat. Nos. 5,366,892; 5,747,450; 5,737,514; 5,723,756; 5,593, 881; and Geiser et al., (1986) Gene 48:109), lectins (Van Damme et al. (1994) Plant Mol. Biol. 24:825, pentin (described in U.S. Pat. No. 5,981,722), and the like; traits desirable for disease or herbicide resistance (e.g., fumonisin detoxification genes (U.S. Pat. No. 5,792,931); avirulence and disease resistance genes (Jones et al. (1994) Science 266:789; Martin et al., (1993) Science 262:1432; Mindrinos et al. (1994) Cell 78:1089); acetolactate synthase (ALS) mutants that lead to herbicide resistance such as the S4 and/or Hra mutations; glyphosate resistance (e.g., 5-enol-pyrovyl-shikimate-3-phosphate-synthase (EPSPS) gene, described in U.S. Pat. Nos. 4,940,935 and 5,188,642; or the glyphosate N-acetyltransferase (GAT) gene, described in Castle et al. (2004) Science, 304:1151-1154; and in U.S. Patent App. Pub. Nos. 20070004912, 20050246798, and 20050060767)); glufosinate resistance (e.g, phosphinothricin acetyl transferase genes PAT and BAR, described in U.S. Pat. Nos. 5,561,236 and 5,276,268); resistance to herbicides including sulfonyl urea, DHT (2,4D), and PPO herbicides (e.g., glyphosate acetyl transferase, aryloxy alkanoate dioxygenase, acetolactate synthase, and protoporphyrinogen oxidase); a cytochrome P450 or variant thereof that confers herbicide resistance or tolerance to, inter alia, HPPD herbicides (U.S. patent application Ser. No. 12/156,247; U.S. Pat. Nos. 6,380,465; 6,121,512; 5,349,127; 6,649,814; and 6,300,544; and PCT Patent App. Pub. No. WO2007000077); and traits desirable for processing or process products such as high oil (e.g., U.S. Pat. No. 6,232,529); modified oils (e.g., fatty acid desaturase genes (U.S. Pat. No. 5,952,544; WO 94/11516)); modified starches (e.g., ADPG pyrophosphorylases (AGPase), starch synthases (SS), starch branching enzymes (SBE), and starch debranching enzymes (SDBE)); and polymers or bioplastics (e.g., U.S. Pat. No. 5,602,321; beta-ketothiolase, polyhydroxybutyrate synthase, and acetoacetyl-CoA reductase (Schubert et al. (1988) J. Bacteriol. 170:5837-5847) facilitate expression of polyhydroxyalkanoates (PHAs)); the disclosures of which are herein incorporated by reference.

Generally, the term "herbicide" is used herein to mean an active ingredient that kills, controls or otherwise adversely modifies the growth of plants. The preferred amount or concentration of the herbicide is an "effective amount" or "effective concentration." By "effective amount" and "effective concentration" is intended an amount and concentration, respectively, that is sufficient to kill or inhibit the growth of a similar, wild-type, plant, plant tissue, plant cell, or host cell, but that said amount does not kill or inhibit as severely the growth of the herbicide-resistant plants, plant tissues, plant cells, and host cells of the present invention. Typically, the effective amount of a herbicide is an amount that is routinely used in agricultural production systems to kill weeds of interest. Such an amount is known to those of ordinary skill in the art. Herbicidal activity is exhibited by herbicides useful for the the present invention when they are applied directly to the plant or to the locus of the plant at any stage of growth or before planting or emergence. The effect observed depends upon the plant species to be controlled, the stage of growth of the plant, the application parameters of dilution and spray drop size, the particle size of solid components, the environmental conditions at the time of use, the specific compound employed, the specific adjuvants and carriers employed, the soil type, and the like, as well as the amount of chemical applied. These and other factors can be adjusted as is known in the art to promote non-selective or selective herbicidal action. Generally, it is preferred to apply the herbicide postemergence to relatively immature undesirable vegetation to achieve the maximum control of weeds.

By a "herbicide-tolerant" or "herbicide-resistant" plant, it is intended that a plant that is tolerant or resistant to at least one herbicide at a level that would normally kill, or inhibit the growth of, a normal or wild-type plant. By "herbicide-tolerant wildtype or chimeric polypeptide protein" or "herbicide-resistant wildtype or chimeric polypeptide protein", it is intended that such a chimeric polypeptide displays higher PPO activity, relative to the PPO activity of a wild-type chimeric polypeptide, when in the presence of at least one herbicide that is known to interfere with PRO activity and at a concentration or level of the herbicide that is known to inhibit the PRO activity of the wild-type chimeric polypeptide protein. Furthermore, the PPO activity of such a herbicide-tolerant or herbicide-resistant chimeric polypeptide protein may be referred to herein as "herbicide-tolerant" or "herbicide-resistant" PRO activity.

Generally, if the PRO-inhibiting herbicides (also referred to as compounds A) and/or the herbicidal compounds B as described herein, which can be employed in the context of the present invention, are capable of forming geometrical isomers, for example E/Z isomers, it is possible to use both, the pure isomers and mixtures thereof, in the compositions useful for the present the invention. If the PPO-inhibting herbicides A and/or the herbicidal compounds B as described herein have one or more centers of chirality and, as a consequence, are present as enantiomers or diastereomers, it is possible to use both, the pure enantiomers and diastereomers and their mixtures, in the compositions according to the invention. If the PPO-inhibiting herbicides A and/or the herbicidal compounds B as described herein have ionizable functional groups, they can also be employed in the form of their agriculturally acceptable salts. Suitable are, in general, the salts of those cations and the acid addition salts of those acids whose cations and anions, respectively, have no adverse effect on the activity of the active compounds. Preferred cations are the ions of the alkali metals, preferably of lithium, sodium and potassium, of the alkaline earth metals, preferably of calcium and magnesium, and of the transition metals, preferably of manganese, copper, zinc and iron, further ammonium and substituted ammonium in which one to four hydrogen atoms are replaced by $C_1$-$C_4$-alkyl, hydroxy-$C_1$-$C_4$-alkyl, $C_1$-$C_4$-alkoxy-$C_1$-$C_4$-alkyl, hydroxy-$C_1$-$C_4$-alkoxy-$C_1$-$C_4$-alkyl, phenyl or benzyl, preferably ammonium, methylammonium, isopropylammonium, dimethylammonium, diisopropylammonium, trimethylammonium, heptylammonium, dodecylammonium, tetradecylammonium, tetramethylammonium, tetraethylammonium, tetrabutylammonium, 2-hydroxyethylammonium (olamine salt), 2-(2-hydroxyeth-1-oxy)eth-1-ylammonium (diglycolamine salt), di(2-hydroxyeth-1-yl) ammonium (diolamine salt), tris(2-hydroxyethyl) ammonium (trolamine salt), tris(2-hydroxypropyl) ammoniurn, benzyltrimethylammonium, benzyltriethylammonium, N,N,N-trimethylethanolammonium (choline salt), furthermore phosphonium ions, sulfonium ions, preferably tri($C_1$-$C_4$-alkyl)sulfonium, such as trinethylsulfonium, and sulfoxonium ions, preferably tri($C_1$-$C_4$-alkyl)sulfoxonium, and finally the salts of polybasic amines such as N,N-bis-(3-aminopropyl)methylamine and diethylenetriamine. Anions of useful acid addition salts are primarily chloride, bromide, fluoride, iodide, hydrogensulfate, methylsulfate, sulfate, dihydrogenphosphate, hydrogenphosphate, nitrate, bicarbonate, carbonate, hexafluorosilicate, hexafluorophosphate, benzoate and also the anions of $C_1$-$C_4$-alkanoic acids, preferably formate, acetate, propionate and butyrate.

The PPO-inhibiting herbicides A and/or the herbicidal compounds B as described herein having a carboxyl group can be employed in the form of the acid, in the form of an agriculturally suitable salt as mentioned above or else in the form of an agriculturally acceptable derivative, for example as amides, such as mono- and di-$C_1$-$C_6$-alkylamides or arylamides, as esters, for example as allyl esters, propargyl esters, $C_1$-$C_{10}$-alkyl esters, alkoxyalkyl esters, tefuryl ((tetrahydrofuran-2-yl)methyl) esters and also as thioesters, for example as $C_1$-$C_{10}$-alkylthio esters. Preferred mono- and di-$C_1$-$C_6$-alkylamides are the methyl and the dimethylamides. Preferred arylamides are, for example, the anilides and the 2-chloroanilides. Preferred alkyl esters are, for example, the methyl, ethyl, propyl, isopropyl, butyl, isobutyl, pentyl, mexyl (1-methylhexyl), meptyl (1-methylheptyl), heptyl, octyl or isooctyl (2-ethylhexyl) esters. Preferred $C_1$-$C_4$-alkoxy-$C_1$-$C_4$-alkyl esters are the straight-chain or branched $C_1$-$C_4$-alkoxy ethyl esters, for example the 2-methoxy-ethyl, 2-ethoxyethyl, 2-butoxyethyl (butotyl), 2-butoxypropyl or 3-butoxypropyl ester. An example of a straight-chain or branched $C_1$-$C_{10}$-alkylthio ester is the ethylthio ester.

Examples of PPO inhibiting herbicides which can be used according to the present invention are acifluorfen, acifluorfen-sodium, aclonifen, azafenidin, bencarbazone, benzfendizone, bifenox, butafenacil, carfentrazone, carfentrazone-ethyl, chlomethoxyfen, cinidon-ethyl, fluazolate, flufenpyr, flufenpyr-ethyl, flumiclorac, flumiclorac-pentyl, flumioxazin, fluoroglycofen, fluoroglycofen-ethyl, fluthiacet, fluthiacet-methyl, fomesafen, halosafen, lactofen, oxadiargyl, oxadiazon, oxyfluorfen, pentoxazone, profluazol, pyraclonil, pyraflufen, pyraflufen-ethyl, saflufenacil, sulfentrazone, thidiazimin, tiafenacil, chlornitrofen, flumipropyn, fluoronitrofen, flupropacil, furyloxyfen, nitrofluorfen, ethyl [3-[2-chloro-4-fluoro-5-(1-methyl-6-trifluoromethyl-2,4-dioxo-1,2,3,4-tetrahydropyrimidin-3-yl)phenoxy]-2-pyridyloxy]acetate (CAS 353292-31-6; S-3100), N-ethyl-3-2,6-dichloro-4-trifluoromethylphenoxy)-5-methyl-1H-pyrazole-1-carboxamide (CAS 452098-92-9), N-tetrahydrofurfuryl-3-(2,6-dichloro-4-trifluoromethylphenoxy)-5-methyl-1H-pyrazole-1-carboxamide (CAS 915396-43-9), N-ethyl-3-(2-chloro-6-fluoro-4-trifluoromethylphenoxy)-5-methyl-1H-pyrazole-1-carboxamide (CAS 452099-05-7), N-tetrahydrofurfuryl-3-(2-chloro-6-fluoro-4-trifluoromethylphenoxy)-5-methyl-1H-pyrazole-1-carboxamide (CAS 452100-03-7), 3-[7-fluoro-3-oxo-4-(prop-2-ynyl)-3,4-dihydro-2H-benzo[1,4]oxazin-6-yl]-1,5-dimethyl-6-thioxo-[1,3,5]triazinan-2,4-dione (CAS 451484-50-7), 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), 2-(2,2,7-Trifluoro-3-oxo-4-prop-2-ynyl-3,4-dihydro-2H-benzo[1,4]oxazin-6-yl)-4,5,6,7-tetrahydro-isoindole-1,3-dione (CAS 1300118-96-0), 1-Methyl-6-trifluoromethyl-3-(2,2,7-trifluoro-3-oxo-4-prop-2-ynyl-3,4-dihydro-2H-benzo[1,4]oxazin-6-yl)-1H-pyrimidine-2,4-dione, methyl (E)-4-[2-chloro-5-[4-chloro-5-(difluoromethoxy)-1H-methyl-pyrazol-3-yl]-4-fluoro-phenoxy]-3-methoxy-but-2-enoate [CAS 948893-00-3], 3-[7-Chloro-5-fluoro-2-(trifluoromethyl)-1H-benzimidazol-4-yl]-1-methyl-6-(trifluoromethyl)-1H-pyrimidine-2,4-dione (CAS 212754-02-4), and uracils of formula III

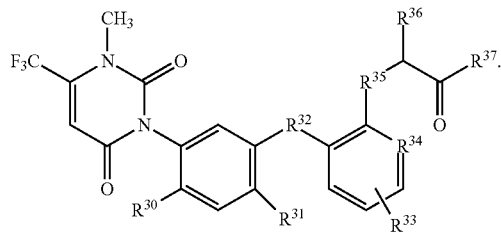

wherein
$R^{30}$ and $R^{31}$ independently of one another are F, Cl or CN;
$R^{32}$ is O or S;
$R^{33}$ is H, F, Cl, $CH_3$ or $OCH_3$;
$R^{34}$ is CH or N;

$R^{35}$ is O or S;
$R^{36}$ is H, CN, $CH_3$, $CF_3$, $OCH_3$, $OC_2H_5$, $SCH_3$, $SC_2H_5$, $(CO)OC_2H_5$ or $CH_2R^{38}$, wherein $R^{38}$ is F, Cl, $OCH_3$, $SCH_3$, $SC_2H_5$, $CH_2F$, $CH_2Br$ or $CH_2OH$;
and
$R^{37}$ is ($C_1$-$C_6$-alkyl)amino, ($C_1$-$C_6$-dialkyl)amino, (NH)$OR^{39}$, OH, $OR^{40}$ or $SR^{40}$ wherein $R^{39}$ is $CH_3$, $C_2H_5$ or phenyl; and
$R^{40}$ is independently of one another $C_1$-$C_6$-alkyl, $C_2$-$C_6$-alkenyl, $C_3$-$C_6$-alkynyl, $C_1$-$C_6$-haloalkyl, $C_1$-$C_6$-alkoxy-$C_1$-$C_6$-alkyl, $C_1$-$C_6$-alkoxy-$C_1$-$C_6$-alkoxy-$C_1$-$C_6$-alkyl, $C_2$-$C_6$-cyanoalkyl, $C_1$-$C_4$-alkoxy-carbonyl-$C_1$-$C_4$-alkyl, $C_1$-$C_4$-alkyl-carbonyl-amino, $C_1$-$C_6$-alkylsulfinyl-$C_1$-$C_6$-alkyl, $C_1$-$C_6$-alkyl-sulfonyl-$C_1$-$C_6$-alkyl, $C_1$-$C_6$-dialkoxy-$C_1$-$C_6$-alkyl, $C_1$-$C_6$-alkylcarbonyloxy-$C_1$-$C_6$-alkyl, phenyl-carbonyl-$C_1$-$C_6$-alkyl, tri($C_1$-$C_3$-alkyl)-silyl-$C_1$-$C_6$-alkyl, tri($C_1$-$C_3$-alkyl)-silyl-$C_1$-$C_6$-alkynyl, tri($C_1$-$C_3$-alkyl)-silyl-$C_1$-$C_6$-alkynyl, tri($C_1$-$C_3$-alkyl)-silyl-$C_1$-$C_6$-alkyl, dimethylamino, tetrahydropyranyl, tetrahydrofuranyl-$C_1$-$C_3$-alkyl, phenyl-$C_1$-$C_6$-alkoxy-$C_1$-$C_6$-alkyl, phenyl-$C_1$-$C_3$-alkyl, pyridyl-$C_1$-$C_3$-alkyl, pyridyl, phenyl,
which pyridyls and phenyls independently of one another are substituted by one to five substituents selected from the group consisting of halogen, $C_1$-$C_3$-alkyl or $C_1$-$C_2$-haloalkyl;
$C_3$-$C_6$-cycloalkyl or $C_3$-$C_6$-cycloalkyl-$C_1$-$C_4$-alkyl, which cycloalkyls indenpently of one another are unsubstituted or substituted by one to five substituents selected from the group consisting of halogen, $C_1$-$C_3$-alkyl and $C_1$-$C_2$-haloalkyl;
including their agriculturally acceptable alkali metal salts or ammonium salts.

Preferred PPO-inhibiting herbicides that can be used according to the present invention are: Acifluorfen, acifluorfen-sodium, azafenidin, bencarbazone, benzfendizone, butafenacil, carfen-trazone-ethyl, cinidon-ethyl, flufenpyr-ethyl, fiumiclorac-pentyl, flumioxazin, fluoroglycofen-ethyl, fluthiacet-methyl, fomesafen, lactofen, oxadiargyl, oxadiazon, oxyfluorfen, pentoxazone, pyraflufen-ethyl, saflufenacil, sulfentrazone, ethyl [3-[2-chloro-4-fluoro-5-(1-methyl-6-trifluoromethyl-2,4-dioxo-1,2,3,4-tetrahydropyrimidin-3-yl)phenoxy]-2-pyridyloxy]acetate (CAS 353292-31-6; S-3100), N-ethyl-3-(2,6-dichloro-4-trifluoromethylphenoxy)-5-methyl-1H-pyrazole-1-carboxamide (CAS 452098-92-9), N-tetrahydrofurfuryl-3-(2,6-dichloro-4-trifluoromethylphenoxy)-5-methyl-1H-pyrazole-1-carboxamide (CAS 915396-43-9), N-ethyl-3-(2-chloro-6-fluoro-4-trifluoromethylphenoxy)-5-methyl-1H-pyrazole-1-carboxamide (CAS 452099-05-7), N-tetrahydrofurfuryl-3-(2-chloro-6-fluoro-4-trifluoromethylphenoxy)-5-methyl-1H-pyrazole-1-carboxamide (CAS 452100-03-7), 3-[7-fluoro-3-oxo-4-(prop-2-ynyl)-3,4-dihydro-2H-benzo[1,4]oxazin-6-yl]-1,5-dimethyl-6-thioxo-[1,3,5]triazinan-2,4-dione (CAS 451484-50-7), 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), 2-(2,2,7-Trifluoro-3-oxo-4-prop-2-ynyl-3,4-dihydro-2H-benzo[1,4]oxazin-6-yl)-4,5,6,7-tetrahydro-isoindole-1,3-dione (CAS 1300118-96-0); 1-Methyl-6-trifluoromethyl-3-(2,2,7-trifluoro-3-oxo-4-prop-2-ynyl-3,4-dihydro-2H-benzo[1,4]oxazin-6-yl)-1H-pyrimidine-2,4-dione (CAS 1304113-05-0), 3-[7-Chloro-5-fluoro-2-(trifluoromethyl)-1H-benzimidazol-4-yl]-1-methyl-6-(trifluoromethyl)-1H-pyrimidine-2,4-dione (CAS 212754-02-4)

uracils of formula III.1 (corresponding to uracils of formula III, wherein $R^{30}$ is F, $R^{31}$ is Cl, $R^{32}$ is O; $R^{33}$ is H; $R^{34}$ is CH; $R^{35}$ is O and $R^{37}$ is $OR^{40}$)

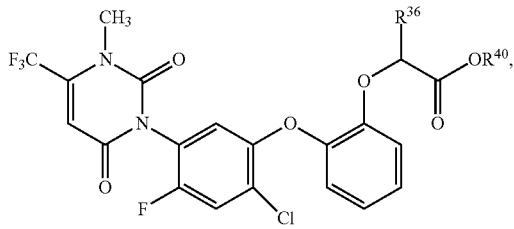

III.1 wherein
$R^{36}$ is $OCH_3$, $OC_2H_5$, $SCH_3$ or $SC_2H_5$;
and
$R^{40}$ is $C_1$-$C_6$-alkyl, $C_2$-$C_6$-alkenyl, $C_3$-$C_6$-alkynyl, $C_1$-$C_6$-haloalkyl, $C_1$-$C_6$-alkoxy-$C_1$-$C_6$-alkyl, $C_1$-$C_6$-alkoxy-$C_1$-$C_6$-alkoxy-$C_1$-$C_6$-alkyl, $C_1$-$C_3$-cyanoalkyl, phenyl-$C_1$-$C_3$-alkyl, pyridyl-$C_1$-$C_3$-alkyl, $C_3$-$C_6$-cycloalkyl or $C_3$-$C_6$-cycloalkyl-$C_1$-$C_4$-alkyl, which cycloalkyls are unsubstituted or substituted by one to five substituents selected from the group consisting of halogen, $C_1$-$C_3$-alkyl and $C_1$-$C_2$-haloalkyl;
and uracils of formula III.2 (corresponding to uracils of formula III, wherein $R^{30}$ is F; $R^{31}$ is Cl; $R^{32}$ is O; $R^{33}$ is H; $R^{34}$ is N; $R^{35}$ is O and $R^{37}$ is $OR^{40}$ with $R^{40}$ is $C_1$-$C_6$-alkyl)

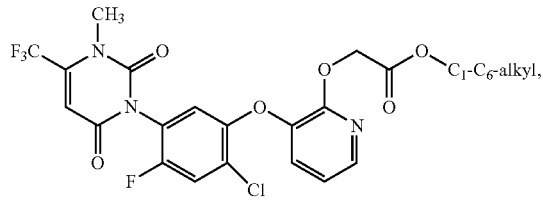

III.2

Particularly preferred PPO-inhibiting herbicides that can be used according to the present invention are:
acifluorfen, acifluorfen-sodium, butafenacil, carfentrazone-ethyl, cinidon-ethyl, flumioxazin, fluthiacet-methyl, fomesafen, lactofen, oxadiargyl, oxyfluorfen, saflufenacil, sulfentrazone, ethyl [3-[2-chloro-4-fluoro-5-(1-methyl-6-trifluoromethyl-2,4-dioxo-1,2,3,4-tetrahydropyrimidin-3-yl)-phenoxy]-2-pyridyloxy]acetate (CAS 353292-31-6; S-3100), 3-[7-fluoro-3-oxo-4-(prop-2-ynyl)-3,4-dihydro-2H-benzo[1,4]oxazin-6-yl]-1,5-dimethyl-6-thioxo-[1,3,5]triazinan-2,4-dione (CAS 451484-50-7), 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4=trifludimoxazin), and 2-(2,2,7-Trifluoro-3-oxo-4-prop-2-ynyl-3,4-dihydro-2H-benzo[1,4]oxazin-6-yl)-4,5,6,7-tetrahydro-isoindole-1,3-dione (CAS 1300118-96-0), 1-Methyl-6-trifluoromethyl-3-(2,2,7-trifluoro-3-oxo-4-prop-2-ynyl-3,4-dihydro-2H-benzo[1,4]oxazin-6-yl)-1H-pyrimidine-2,4-dione (CAS 1304113-05-0), uracils of formula III.1.1 (corresponding to uracils of formula Ill, wherein. $R^{30}$ is F, $R^{31}$ is Cl, $R^{32}$ is O; $R^{33}$ is H; $R^{34}$ is CH; $R^{35}$ is O, $R^{36}$ is $OCH_3$ and $R^{37}$ is $OR^{40}$)

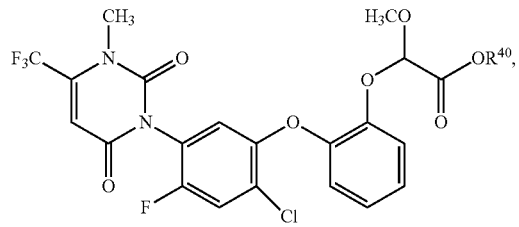

III.1.1 wherein
$R^{40}$ is $C_1$-$C_6$-alkyl, $C_2$-$C_6$-alkenyl, $C_3$-$C_6$-alkynyl, $C_1$-$C_6$-haloalkyl, $C_1$-$C_6$-alkoxy-$C_1$-$C_6$-alkyl, $C_1$-$C_6$-alkoxy-$C_1$-$C_6$-alkoxy-$C_1$-$C_6$-alkyl, $C_1$-$C_3$-cyanoalkyl, phenyl-$C_1$-$C_3$-alkyl, pyridyl-$C_1$-$C_3$-alkyl, $C_3$-$C_6$-cycloalkyl or $C_3$-$C_6$-cycloalkyl-$C_1$-$C_4$-alkyl,
which cycloalkyls are unsubstituted or substituted by one to five substituents selected from the group consisting of halogen, $C_1$-$C_3$-alkyl and $C_1$-$C_2$-haloalkyl; is preferably $CH_3$, $CH_2CH_2OC_2H_5$, $CH_2CHF_2$, cyclohexyl, (1-methylcyclopropyl)methyl or $CH_2$(pyridine-4-yl);

uracils of formula III.2.1 (corresponding to uracils of formula III, wherein $R^{30}$ is F; $R^{31}$ is Cl; $R^{32}$ is O; $R^{33}$ is H; $R^{34}$ is N; $R^{35}$ is O and $R^{37}$ is $OR^{40}$ with $R^{40}$ is $CH_3$)

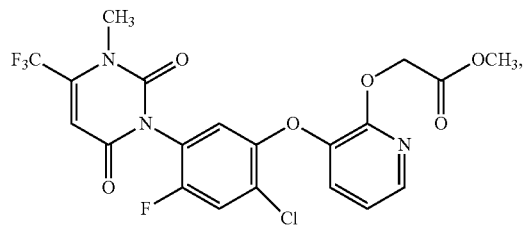

III.2.1 and
uracils of formula III.2.2 (corresponding to uracils of formula III, wherein $R^{30}$ is F; R is Cl; $R^{32}$ is O; $R^{33}$ is H; $R^{34}$ is N; $R^{35}$ is O and $R^{37}$ is $OR^{40}$ with $R^{40}$ is $C_2H_5$)

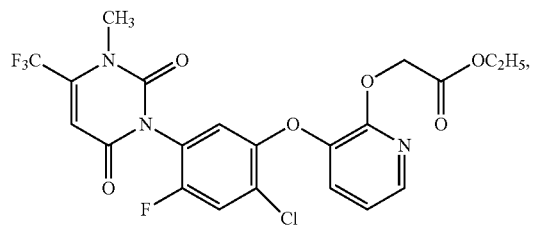

III.2.2

Especially preferred PPO-inhibiting herbicides are the PPO-inhibiting herbicides. 1 to A.15 listed below in table A:

TABLE A

| | |
|---|---|
| A.1 | acifluorfen |
| A.2 | butafenacil |
| A.3 | carfentrazone-ethyl |
| A.4 | cinidon-ethyl |

TABLE A-continued

| A.5 | flumioxazin |
|---|---|
| A.6 | fluthiacet-methyl |
| A.7 | fomesafen |
| A.8 | lactofen |
| A.9 | oxadiargyl |
| A.10 | oxyfluorfen |
| A.11 | saflufenacil |
| A.12 | sulfentrazone |
| A.13 | ethyl [3-[2-chloro-4-fluoro-5-(1-methyl-6-trifluoromethyl-2,4-dioxo-1,2,3,4-tetrahydropyrimidin-3-yl)phenoxy]-2-pyridyloxy]acetate (CAS 353292-31-6) |
| A.14 | 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4) [trifludimoxazine] |
| A.15 | Phenylpyridines as disclosed in WO 2016/120116 |

The PPO-inhibiting herbicides described above that are useful to carry out the present invention are often best applied in conjunction with one or more other herbicides to obtain control of a wider variety of undesirable vegetation. For example, PPO-inhibiting herbicides may further be used in conjunction with additional herbicides to which the crop plant is naturally tolerant, or to which it is resistant via expression of one or more additional transgenes as mentioned supra, or to which it is resistant via mutagenesis and breeding methods as described hereinafter. When used in conjunction with other targeting herbicides, the PPO-inhibiting herbicides, to which the plant of the present invention had been made resistant or tolerant, can be formulated with the other herbicide or herbicides, tank mixed with the other herbicide or herbicides, or applied sequentially with the other herbicide or herbicides.

Suitable components for mixtures are, for example, selected from the herbicides of class b1) to b15)

B) herbicides of class b1) to b15):
b1) lipid biosynthesis inhibitors;
b2) acetolactate synthase inhibitors (ALS inhibitors);
b3) photosynthesis inhibitors;
b4) protoporphyrinogen-IX oxidase inhibitors,
b5) bleacher herbicides;
b6) enolpyruvyl shikimate 3-phosphate synthase inhibitors (EPSP inhibitors);
b7) glutamine synthetase inhibitors;
b8) 7,8-dihydropteroate synthase inhibitors (DHP inhibitors);
b9) mitosis inhibitors;
b10) inhibitors of the synthesis of very long chain fatty acids (VLCFA inhibitors);
b11) cellulose biosynthesis inhibitors;
b12) decoupler herbicides;
b13) auxinic herbicides;
b14) auxin transport inhibitors; and
b15) other herbicides selected from the group consisting of bromobutide, chlorflurenol, chlorflurenol-methyl, cinmethylin, cumyluron, dalapon, dazomet, difenzoquat, difenzoquat-metilsulfate, dimethipin, DSMA, dymron, endothal and its salts, etobenzanid, flamprop, flamprop-isopropyl, flamprop-methyl, flamprop-M-isopropyl, flamprop-M-methyl, flurenol, flurenol-butyl, flurprimidol, fosamine, fosamine-ammonium, indanofan, indaziflam, maleic hydrazide, mefluidide, metam, methiozolin (CAS 403640-27-7), methyl azide, methyl bromide, methyl-dymron, methyl iodide, MSMA, oleic acid, oxaziclomefone, pelargonic acid, pyributicarb, quinoclamine, triaziflam, tridiphane and 6-chloro-3-(2-cyclopropyl-6-methylphenoxy)-4-pyridazinol (CAS 499223-49-3) and its salts and esters;

including their agriculturally acceptable salts or derivatives.

Examples of herbicides B which can be used in combination with the PPO-inhibiting herbicides according to the present invention are:

b1) from the group of the lipid biosynthesis inhibitors:
ACC-herbicides such as alloxydim, alloxydim-sodium, butroxydim, ciethodim, clodinafop, clodinafop-propargyl, cycloxydim, cyhalofop, cyhalofop-butyl, diclofop, diclofop-methyl, fenoxaprop, fenoxaprop-ethyl, fenoxaprop-P, fenoxaprop-P-ethyl, fluazifop, fluazifop-butyl, fluazifop-P, fluazifop-P-butyl, haloxyfop, haloxyfop-methyl, haloxyfop-P, haloxyfop-P-methyl, metamifop, pinoxaden, profoxydim, propaquizafop, quizalofop, quizalofop-ethyl, quizalofop-tefuryl, quizalofop-P, quizalofop-P-ethyl, quizalofop-P-tefuryl, sethoxydim, tepraloxydim, tralkoxydim, 4-(4'-Chloro-4-cyclopropyl-2'-fluoro[1,1'-biphenyl]-3-yl)-5-hydroxy-2,2,6,6-tetramethyl-2H-pyran-3(6H)-one (CAS 1312337-72-6); 4-(2',4'-Dichloro-4-cyclopropyl[1,1-biphenyl]-3-yl)-5-hydroxy-2,2,6,6-tetramethyl-2H-pyran-3(6H)-one (CAS 1312337-45-3); 4-(4'-Chloro-4-ethyl-2'-fluoro[1,1'-biphenyl]-3-yl)-5-hydroxy-2,2,6,6-tetramethyl-2H-pyran-3(6H)-one (CAS 1033757-93-5); 4-(2',4'-Dichloro-4-ethyl[1,1'-biphenyl]-3-yl)-2,2,6,6-tetramethyl-2H-pyran-3,5(4H,6H)-dione (CAS 1312340-84-3); 5-(Acetyloxy)-4-(4'-chloro-4-cyclopropyl-2'-fluoro[1,1'-biphenyl]-3-yl)-3,6-dihydro-2,2,6,6-tetramethyl-2H-pyran-3-one (CAS 1312337-48-6); 5-(Acetyloxy)-4-(2',4'-dichloro-4-cyclopropyl-[1,1'-biphenyl]-3-yl)-3,6-dihydro-2,2,6,6-tetramethyl-2H-pyran-3-one; 5-(Acetyloxy)-4-(4'-chloro-4-ethyl-Z-fluoro[1,1'-biphenyl]-3-yl)-3,6-dihydro-2,2,6,6-tetramethyl-2H-pyran-3-one (CAS 1312340-82-1); 5-(Acetyloxy)-4-(2',4'-dichloro-4-ethyl[1,1'-biphenyl]-3-yl)-3,6-dihydro-2,2,6,6-tetramethyl-2H-pyran-3-one (CAS 1033760-55-2); 4-(4'-Chloro-4-cyclopropyl-2'-fluoro[1,1'-biphenyl]-3-yl)-5,6-dihydro-2,2,6,6-tetramethyl-5-oxo-2H-pyran-3-ylcarbonic acid methyl ester (CAS 1312337-51-1); 4-(2',4'-Dichloro-4-cyclopropyl-[1,1'-biphenyl]-3-yl)-5,6-dihydro-2,2,6,6-tetramethyl-5-oxo-2H-pyran-3-yl carbonic acid methyl ester; 4-(4'-Chloro-4-ethyl-2'-fluoro[1,1'-biphenyl]-3-yl)-5,6-dihydro-2,2,6,6-tetramethyl-5-oxo-2H-pyran-3-ylcarbonic acid methyl ester (CAS 1312340-83-2); 4-(2',4'-Dichloro-4-ethyl[1,1'-biphenyl]-3-yl)-5,6-dihydro-2,2,6,6-tetramethyl-5-oxo-2H-pyran-3-ylcarbonic acid methyl ester (CAS 1033760-58-5); and non ACC herbicides such as benfuresate, butylate, cycloate, dalapon, dimepiperate, EPTC, esprocarb, ethofumesate, flupropanate, molinate, orbencarb, pebulate, prosulfocarb, TCA, thiobencarb, tiocarbazil, triallate and vernolate;

b2) from the group of the ALS inhibitors:
sulfonylureas such as amidosulfuron, azimsulfuron, bensulfuron, bensulfuron-methyl, chlorimuron, chlorimuron-ethyl, chlorsulfuron, cinosulfuron, cyclosulfamuron, ethametsulfuron, ethametsulfuron-methyl, ethoxysulfuron, flazasulfuron, flucetosulfuron, flupyrsulfuron, flupyrsulfuron-methyl-sodium, foramsulfuron, halosulfuron, halosulfuron-methyl, imazosulfuron, iodosulfuron, iodosulfuron-methyl-sodium, iofensulfuron, iofensulfuron-sodium, mesosulfuron, metazosulfuron, metsulfuron, metsulfuron-methyl, nicosulfuron, orthosulfamuron, oxasulfuron, primisulfuron, primisulfuron-methyl, propyrisulfuron, prosulfuron, pyrazosulfuron, pyrazosulfuron-ethyl, rimsulfuron, sulfometuron, sulfometuron-methyl, sulfosulfuron, thifensulfuron, thifensulfuron-methyl, triasulfuron, tribenuron, tribenuron-methyl, trifloxysulfuron, triflusulfuron, triflusulfuron-methyl and tritosulfuron, imidazolinones such as imazamethabenz, imazamethabenz-methyl, imazamox, imazapic, imazapyr, imazaquin and imazethapyr, triazolopyrimidine herbicides and sulfonanilides such as cloransulam, cloransulam-methyl, diclosulam, flumetsulam, florasulam, metosulam, penoxsulam, pyrimisulfan and pyroxsulam, pyrimidinylbenzoates such as bispyribac, bispyribac-sodium, pyribenzoxim, pyriftalid, pyrirninobac, pyriminobac-methyl, pyrithiobac, pyrithiobac-sodium, 4-[[[2-[(4,6-dimethoxy-2-pyrimidinyl)oxy]phenyl]methyl]amino]-benzoic acid-1-methylethyl ester (CAS 420138-41-6), 4-[[[2-[(4,6-dimethoxy-2-pyrimidinyl)oxy]phenyl]methyl]amino]-benzoic acid propyl ester (CAS 420138-40-5), N-(4-bromophenyl)-2-[(4,6-dimethoxy-2-pyrimidinyl)oxy] benzenemethanamine (CAS 420138-01-8), sulfonylaminocarbonyl-triazolinone herbicides such as flucarbazone, flucarbazone-sodium, propoxycarbazone, propoxycarbazone-sodium, thiencarbazone and thiencarbazone-methyl; and triafamone;

among these, a preferred embodiment of the invention relates to those compositions comprising at least one imidazolinone herbicide;

b3) from the group of the photosynthesis inhibitors:

amicarbazone, inhibitors of the photosystem II, e.g. triazine herbicides, including of chlorotriazine, triazinones, triazindiones, methylthiotriazines and pyridazinones such as ametryn, atrazine, chloridazon, cyanazine, desmetryn, dimethametryn, hexazinone, metribuzin, prometon, prometryn, propazine, simazine, simetryn, terbumeton, terbuthylazin, terbutryn and trietazin, aryl urea such as chlorobromuron, chlorotoluron, chloroxuron, dimefuron, diuron, fluometuron, isoproturon, isouron, linuron, metamitron, methabenzthiazuron, metobenzuron, metoxuron, monolinuron, neburon, siduron, tebuthiuron and thiadiazuron, phenyl carbamates such as desmedipham, karbutilat, phenmedipham, phenmedipham-ethyl, nitrile herbicides such as bromofenoxim, bromoxynil and its salts and esters, ioxynil and its salts and esters, uraciles such as bromacil, lenacil and terbacil, and bentazon and bentazon-sodium, pyridate, pyridafol, pentanochlor and propanil and inhibitors of the photosystem I such as diquat, diquat-dibromide, paraquat, paraquat-dichloride and paraquat-dimetilsulfate. Among these, a preferred embodiment of the invention relates to those compositions comprising at least one aryl urea herbicide. Among these, likewise a preferred embodiment of the invention relates to those compositions comprising at least one triazine herbicide. Among these, likewise a preferred embodiment of the invention relates to those compositions comprising at least one nitrile herbicide;

b4) from the group of the protoporphyrinogen-IX oxidase inhibitors:

acifluorfen, acifluorfen-sodium, azafenidin, bencarbazone, benzfendizone, bifenox, butafenacil, carfentrazone, carfentrazone-ethyl, chlomethoxyfen, cinidon-ethyl, fluazolate, flufenpyr, flufenpyr-ethyl, flumiclorac, flumiclorac-pentyl, flumioxazin, fluoroglycofen, fluoroglycofen-ethyl, fluthiacet, fluthiacet-methyl, fomesafen, halosafen, lactofen, oxadiargyl, oxadiazon, oxyfluorfen, pentoxazone, profluazol, pyraclonil, pyraflufen, pyraflufen-ethyl, saflufenacil, sulfentrazone, thidiazimin, tiafenacil, ethyl [3-[2-chloro-4-fluoro-5-(1-methyl-6-trifluoromethyl-2,4-dioxo-1,2,3,4-tetrahydropyrimidin-3-yl)phenoxy]-2-pyridyloxy]acetate (CAS 353292-31-6; S-3100, N-ethyl-3-(2,6-dichloro-4-trifluoromethylphenoxy)-5-methyl-1H-pyrazole-1-carboxamide (CAS 452098-92-9), N-tetrahydrofurfuryl-3-(2,6-dichloro-4-trifluoromethylphenoxy)-5-methyl-1H-pyrazole-1-carboxamide (CAS 915396-43-9), N-ethyl-3-(2-chloro-6-fluoro-4-trifluoromethylphenoxy)-5-methyl-1H-pyrazole-1-carboxamide (CAS 452099-05-7), N-tetrahydrofurfuryl-3-(2-chloro-6-fluoro-4-trifluoromethylphenoxy)-5-methyl-1H-pyrazole-1-carboxamide (CAS 452100-03-7), 3-[7-fluoro-3-oxo-4-(prop-2-ynyl)-3,4-dihydro-2H-benzo[1,4]oxazin-6-yl]-1,5-dimethyl-6-thioxo-[1,3,5]triazinan-2,4-dione, 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), 2-(2,2,7-Trifluoro-3-oxo-4-prop-2-ynyl-3,4-dihydro-2H-benzo[1,4]oxazin-6-yl)-4,5,6,7-tetrahydro-isoindole-1,3-dione, 1-Methyl-6-trifluoromethyl-3-(2,2,7-trifluoro-3-oxo-4-prop-2-ynyl-3,4-dihydro-2H-benzo[1,4]oxa-zin-6-yl)-1H-pyrimidine-2,4-dione (CAS 1304113-05-0), methyl (E)-4-[2-chloro-5-[4-chloro-5-(difluoromethoxy)-1H-methyl-pyrazol-3-yl]-4-fluoro-phenoxy]-3-methoxy-but-2-enoate [CAS 948893-00-3], and 3-[7-Chloro-5-fluoro-2-(trifluoromethyl)-1H-benzimidazol-4-yl]-1-methyl-6-(tri-fluoromethyl)-1H-pyrimidine-2,4-dione (CAS 212754-02-4);

b5) from the group of the bleacher herbicides:

PDS inhibitors: beflubutamid, diflufenican, fluridone, flurochloridone, flurtamone, norflurazon, picolinafen, and 4-(3-trifluoromethylphenoxy)-2-(4-trifluoromethylphenyOpyrimidine (CAS 180608-33-7), HPPD inhibitors: benzobicyclon, benzofenap, clomazone, isoxaflutole, mesotrione, pyrasulfotole, pyrazolynate, pyrazoxyfen, sulcotrione, tefuryltrione, tembotrione, topramezone and bicyclopyrone, bleacher, unknown target: aclonifen, amitrole and flumeturon;

b6) from the group of the EPSP synthase inhibitors:

glyphosate, glyphosate-isopropylammonium, glyposate-potassium and glyphosate-rimesium (sulfosate);

b7) from the group of the glutamine synthase inhibitors:

bilanaphos (bialaphos), bilanaphos-sodium, glufosinate, glufosinate-P and glufosinate-ammonium;

b8) from the group of the DHP synthase inhibitors:

asulam;

b9) from the group of the mitosis inhibitors:

compounds of group K1: dinitroanilines such as benfluralin, butralin, dinitramine, ethalfluralin, fluchloralin, oryzalin, pendimethalin, prodiamine and trifluralin, phosphoramidates such as amiprophos, amiprophos-methyl, and butamiphos, benzoic acid herbicides such as chiorthal, chlorthal-dimethyl, pyridines such as dithiopyr and thiazopyr, benzamides such as propyzamide and tebutam; compounds of group K2: chlorpropham, propham and carbetamide, among these, compounds of group K1, in particular dinitroanilines are preferred;

b10) from the group of the VLCFA inhibitors:

chloroacetamides such as acetochlor, alachlor, butachlor, dimethachlor, dimethenamid, dimethenamid-P, metazachlor, metolachlor, metolachlor-S, pethoxamid, pretilachlor, propachlor, propisochior and thenylchlor, oxyacetanilides such as flufenacet and mefenacet, acetanilides such as diphenamid, naproanilide and napropamide, tetrazolinones such fentrazamide, and other herbicides such as anilofos, cafenstrole, fenoxasulfone, ipfencarbazone, piperophos, pyroxasulfone and isoxazoline compounds of the formulae II.1, II.2, II.3, II.4, II.5, II.6, II.7, II.8 and II.9

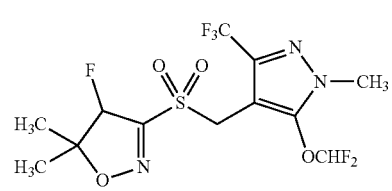

II.1

-continued

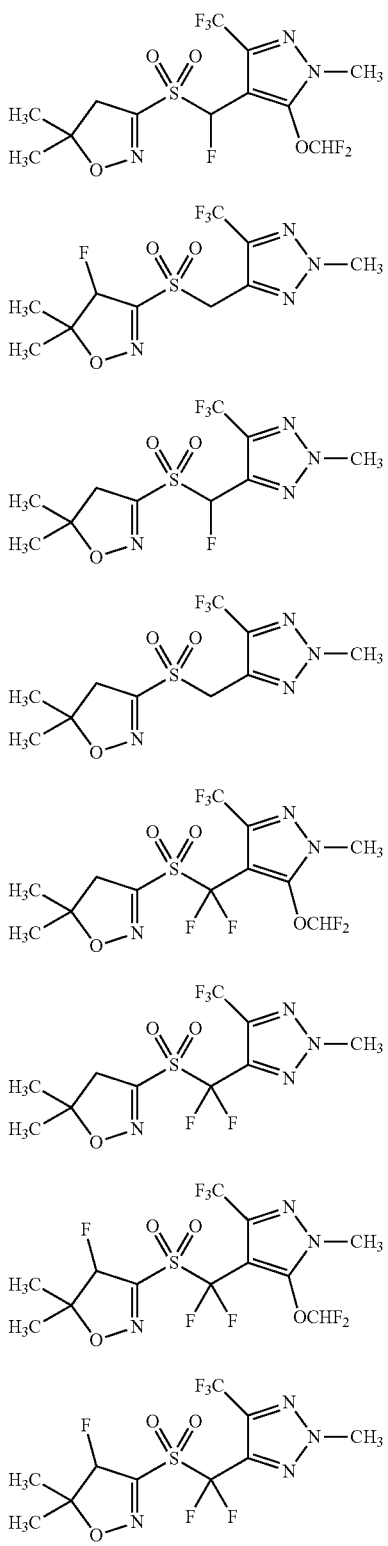

the isoxazoline compounds of the formula (I)I are known in the art, e.g. from WO 2006/024820, WO 2006/037945, WO 2007/071900 and WO 2007/096576;

among the VLCFA inhibitors, preference is given to chloroacetamides and oxyacetamides;

b11) from the group of the cellulose biosynthesis inhibitors:
chlorthiamid, dichlobenil, flupoxam, indaziflam, triaziflam, isoxaben and 1-Cyclohexyl-5-pentafluorphenyloxy-1⁴-[1,2,4,6]thiatriazin-3-ylamine;

b12) from the group of the decoupler herbicides:
dinoseb, dinoterb and DNOC and its salts;

b13) from the group of the auxinic herbicides:
2,4-D and its salts and esters such as clacyfos, 2,4-DB and its salts and esters, aminocyclopyrachlor and its salts and esters, aminopyralid and its salts such as aminopyralid-tris (2-hydroxy-propyl)ammonium and its esters, benazolin, benazolin-ethyl, chloramben and its salts and esters, clomeprop, clopyralid and its salts and esters, dicamba and its salts and esters, dichlorprop and its salts and esters, dichlorprop-P and its salts and esters, fluroxypyr, fluroxypyr-butometyl, fluroxypyr-meptyl, halauxifen and its salts and esters (CAS 943832-60-8); MCPA and its salts and esters, MCPA-thioethyl, MCPB and its salts and esters, mecoprop and its salts and esters, mecoprop-P and its salts and esters, picloram and its salts and esters, quinclorac, quinmerac, TBA (2,3,6) and its salts and esters and triclopyr and its salts and esters;

b14) from the group of the auxin transport inhibitors:
diflufenzopyr, diflufenzopyr-sodium, naptalam and naptalam-sodium;

b15) from the group of the other herbicides: bromobutide, chlorflurenol, chlorflurenol-methyl, cinmethylin, cumyluron, cyclopyrimorate (CAS 499223-49-3) and its salts and esters, dalapon, dazomet, difenzoquat, difenzoquat-metilsulfate, dimethipin, DSMA, dymron, endothal and its salts, etobenzanid, flamprop, flamprop-isopropyl, flamprop-methyl, flamprop-M-isopropyl, flamprop-M-methyl, flurenol, flurenol-butyl, flurprimidol, fosamine, fosamine-ammonium, indanofan, indaziflam, maleic hydrazide, mefluidide, metam, methiozolin (CAS 403640-27-7), methyl azide, methyl bromide, methyl-dymron, methyl iodide, MSMA, oleic acid, oxaziclomefone, pelargonic acid, pyributicarb, quinoclamine, triaziflam and tridiphane.

Preferred herbicides B that can be used in combination with the PPO-inhibiting herbicides according to the present invention are:

b1) from the group of the lipid biosynthesis inhibitors:
clethodim, clodinafop-propargyl, cycloxydim, cyhalofop-butyl, diclofop-methyl, fenoxaprop-P-ethyl, fluazifop-P-butyl, haloxyfop-P-methyl, metamifop, pinoxaden, profoxydim, propaquizafop, quizalofop-P-ethyl, quizalofop-P-tefuryl, sethoxydim, tepraloxydim, tralkoxydim, 4-(4'-Chloro-4-cyclopropyl-2'-fluoro[1,1'-biphenyl]-3-yl)-5-hydroxy-2,2,6,6-tetramethyl-2H-pyran-3(6H)-one (CAS 1312337-72-6); 4-(2',4'-Dichloro-4-cyclopropyl[1,1'-biphenyl]-3-yl)-5-hydroxy-2,2,6,6-teramethyl-2H-pyran-3(6H)-one (CAS 1312337-45-3); 4-(4'-Chloro-4-ethyl-2'-fluoro[1,1'-biphenyl]-3-yl)-5-hydroxy-2,2,6,6-tetramethyl-2H-pyran-3(6H)-one (CAS 1033757-93-5); 4-(2',4'-Dichloro-4-ethyl[1,1'-biphenyl]-3-yl)-2,2,6,6-tetramethyl-2H-pyran-3,5(4H,6H)-dione (CAS 1312340-84-3); 5-(Acetyloxy)-4-(4'-chloro-4-cyclopropyl-2'-fluoro[1,1'-biphenyl]-3-yl)-3,6-dihydro-2,2,6,6-tetramethyl-2H-pyran-3-one (CAS 1312337-48-6); 5-(Acetyloxy)-4-(2',4'-dichloro-4-cyclopropyl-[1,1'-biphenyl]-3-yl)-3,6-dihydro-2,2,6,6-tetramethyl-2H-1-pyran-3-one; 5-(Acetyloxy)-4-(4'-chloro-4-ethyl-2'-fluoro[1,1'-biphenyl]-3-yl)-3,6-dihydro-2,2,6,6-tetramethyl-2H-pyran-3-one (CAS 1312340-82-1); 5-(Acetyloxy)-4-(2',4'-dichloro-4-ethyl[1,1'-biphenyl]-3-yl)-3,6-dihydro-2,2,6,6-tetramethyl-2H-pyran-3-one (CAS 1033760-55-2); 4-(4'-Chloro-4-cyclopropyl-2'-fluoro[1,1'-biphenyl]-3-yl)-5,6- dihydro-2,2,6,6-tetramethyl-5-oxo-2H-pyran-3-yl carbonic acid methyl ester (CAS 1312337-51-1); 4-(2',4'-Dichloro-4-cyclopropyl-[1,1'-biphenyl]-3-yl)-5,6-dihydro-2,2,6,6-tetramethyl-5-oxo-2H-pyran-3-ylcarbonic acid methyl ester; 4-(4'-Chloro-4-ethyl-2'-fluoro[1,1'-biphenyl]-3-yl)-5,6-dihydro-2,2,6,6-tetramethyl-5-oxo-2H-pyran-3-yl carbonic acid methyl ester (CAS 1312340-83-2); 4-(2',4'-Dichloro-4-ethyl[1,1'-biphenyl]-3-yl)-5,6-dihydro-2,2,6,6-tetramethyl-5-oxo-2H-pyran-3-yl carbonic acid methyl ester (CAS 1033760-58-5); benfuresate, dimepiperate, EPTC, esprocarb, ethofumesate, molinate, orbencarb, prosulfocarb, thiobencarb and triallate;

b2) from the group of the ALS inhibitors:
amidosulfuron, azimsulfuron, bensulfuron-methyl, bispyribac-sodium, chlorimuron-ethyl, chlorsulfuron, cloransulam-methyl, cyclosulfamuron, diclosulam, ethametsulfuron-methyl, ethoxysulfuron, flazasulfuron, florasulam, flucarbazone-sodium, flucetosulfuron, flumetsulam, flupyrsulfuron-methyl-sodium, foramsulfuron, halosulfuron-methyl, imazamethabenz-methyl, imazamox, imazapic, imazapyr, imazaquin, imazethapyr, imazosulfuron, iodosulfuron, iodosulfuron-methyl-sodium, iofensulfuron, iofensulfuron-sodium, mesosulfuron, metazosulfuron, metosulam, metsulfuron-methyl, nicosulfuron, orthosulfamuron, oxasulfuron, penoxsulam, primisulfuron-methyl, propoxycarbazon-sodium, propyrisulfuron, prosulfuron, pyrazosulfuron-ethyl, pyribenzoxim, pyrimisulfan, pyriftalid, pyriminobac-methyl, pyrithiobac-sodium, pyroxsulam, rimsulfuron, sulfomefuron-methyl, sulfosulfuron, thiencarbazone-methyl, thifensulfuron-methyl, triasulfuron, tribenuron-methyl, trifloxysulfuron, triflusulfuron-methyl, tritosulfuron and triafamone;

b3) from the group of the photosynthesis inhibitors:
ametryn, amicarbazone, atrazine, bentazone, bentazone-sodium, bromoxynil and its salts and esters, chloridazone, chlorotoluron, cyanazine, desmedipham, diquat-dibromide, diuron, fluometuron, hexazinone, ioxynil and its salts and esters, isoproturon, lenacil, linuron, metamitron, methabenzthiazuron, metribuzin, paraquat, paraquat-dichloride, phenmedipham, propanil, pyridate, simazine, terbutryn, terbuthylazine and thidiazuron;

b4) from the group of the protoporphyrinogen-IX oxidase inhibitors:
acifluorfen, acifluorfen-sodium, azafenidin, bencarbazone, benzfendizone, butafenacil, carfentrazone-ethyl, cinidon-ethyl, flufenpyr-ethyl, flumiclorac-pentyl, flumioxazin, fluoroglycofen-ethyl, fluthiacet-methyl, fomesafen, lactofen, oxadiargyl, oxadiazon, oxyfluorfen, pentoxazone, pyraflufen-ethyl, saflufenacil, sulfentrazone, ethyl [3-[2-chloro-4-fluoro-5-(1-methyl-6-trifluoromethyl-2,4-dioxo-1,2,3,4-tetrahydropyrimidin-3-yl)phenoxy]-2-pyridyloxy]acetate (CAS 353292-31-6; S-3100), N-ethyl-3-(2,6-dichloro-4-trifluoromethylphenoxy)-5-methyl-1H-pyrazole-1-carboxamide (CAS 452098-92-9), N-tetrahydrofurfuryl-3-(2,6-dichloro-4-trifluoromethylphenoxy)-5-methyl-1H-pyrazole-1-carboxamide (CAS 915396-43-9), N-ethyl-3-(2-chloro-6-fluoro-4-trifluoromethylphenoxy)-5-methyl-1H-pyrazole-1-carboxamide (CAS 452099-05-7), N-tetrahydrofurfuryl-3-(2-chloro-6-fluoro-4-trifluoromethylphenoxy)-5-methyl-1H-pyrazole-1-carboxamide (CAS 452100-03-7), 3-[7-fluoro-3-oxo-4-(prop-2-ynyl)-3,4-dihydro-2H-benzo[1,4]oxazin-6-yl]-1,5-dimethyl-6-thioxo-[1,3,5]triazinan-2,4-dione, 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), 2-(2,2,7-Trifluoro-3-oxo-4-prop-2-ynyl-3,4-dihydro-2H-benzo[1,4]oxazin-6-yl)-4,5,6,7-tetrahydroisoindole-1,3-dione; 1-Methyl-6-trifluoromethyl-3-(2,2,7-trifluoro-3-oxo-4-prop-2-ynyl-3,4-dihydro-2H-benzo[1,4]oxazin-6-yl)-1H-pyrimidine-2,4-dione, and 3[7-Chloro-5-fluoro-2-(trifluoromethyl)-1H-benzimidazol-4-yl]-1-methyl-6-(trifluoromethyl)-1H-pyrimidine-2,4-dione (CAS 212754-02-4);

b5) from the group of the bleacher herbicides:
aclonifen, beflubutamid, benzobicyclon, clomazone, diflufenican, flurochloridone, flurtamone, isoxaflutole, mesotrione, norflurazon, picolinafen, pyrasulfotole, pyrazolynate, sulcotrione, tefuryltrione, tembotrione, topramezone, bicyclopyrone, 4-(3-trifluoromethylphenoxy)-2-(4-trifluoro-methylphenyl)pyrimidine (CAS 180608-33-7), amitrole and flumeturon;

b6) from the group of the EPSP synthase inhibitors:
glyphosate, glyphosate-isopropylammonium, glyphosate-potassium and glyphosate-trimesium (sulfosate);

b7) from the group of the glutamine synthase inhibitors:
glufosinate, glufosinate-P, glufosinate-ammonium;

b8) from the group of the DHP synthase inhibitors:
asulam;

b9) from the group of the mitosis inhibitors:
benfluralin, dithiopyr, ethalfluralin, oryzalin, pendimethalin, thiazopyr and trifluralin;

b10) from the group of the VLCFA inhibitors:
acetochlor, alachlor, anilofos, butachlor, cafenstrole, dimethenamid, dimethenamid-P, fentrazamide, flufenacet, mefenacet, metazachlor, metolachlor, S-metolachlor, naproanilide, napropamide, pretilachlor, fenoxasulfone, ipfencarbazone, pyroxasulfone thenylchlor and isoxazoline-compounds of the formulae II.1, II.2, II.3, II.4, II.5, II.6, II.7, II.8 and II.9 as mentioned above;

b11) from the group of the cellulose biosynthesis inhibitors: dichlobenil, flupoxam, isoxaben and 1-Cyclohexyl-5-pentafluorphenyloxy-1$^4$-[1,2,4,6]thiatriazin-3-ylamine;

b13) from the group of the auxinic herbicides:
2,4-D and its salts and esters, aminocyclopyrachlor and its salts and esters, aminopyralid and its salts such as aminopyralid-tris(2-hydroxypropyl)ammonium and its esters, clopyralid and its salts and esters, dicamba and its salts and esters, dichlorprop-P and its salts and esters, fluroxypyrmeptyl, halauxifen and its salts and esters (CAS 943832-60-8), MCPA and its salts and esters, MCPB and its salts and esters, mecoprop-P and its salts and esters, picloram and its salts and esters, quinclorac, quinmerac and triclopyr and its salts and esters;

b14) from the group of the auxin transport inhibitors:
diflufenzopyr and diflufenzopyr-sodium;

b15) from the group of the other herbicides: bromobutide, cinmethylin, cumyluron, cyclopyrimorate (CAS 499223-49-3) and its salts and esters, dalapon, difenzoquat, difenzoquatmetilsulfate, DSMA, dymron (=daimuron), flamprop, flamprop-isopropyl, flamprop-methyl, flam-prop-M-isopropyl, flamprop-M-methyl, indanofan, indaziflam, metam, methylbromide, MSMA, oxaziclomefone, pyributicarb, triaziflam and tridiphane.

Particularly preferred herbicides B that can be used in combination with the PPO-inhibiting herbicides according to the present invention are:

b1) from the group of the lipid biosynthesis inhibitors:
clodinafop-propargyl, cycloxydim, cyhalofop-butyl, fenoxaprop-P-ethyl, pinoxaden, profoxydim, tepraloxydim, tralkoxydim, 4-(4'-Chloro-4-cyclopropyl-2'-fluoro[1,1'-biphenyl]-3-yl)-5-hydroxy-2,2,6,6-tetramethyl-2H-pyran-3(6H)-one (CAS 1312377-72-6); 4-(2',4'-Dichloro-4-cyclopropyl[1,1'-biphenyl]-3-yl)-5-hydroxy-2,2,6,6-tetramethyl-2H-pyran-3(6H)-one (CAS 1312337-45-3); 4-(4'-Chloro-4- ethyl-2'-fluoro[1,1-biphenyl]-3-yl)-5-hydroxy-2,2,6,6-tetramethyl-2H-pyran-3(6H)-one (CAS 1033757-93-5); 4-(2',4'-Dichloro-4-ethyl[1,1'-biphenyl]-3-yl)-2,2,6,6-tetramethyl-2H-pyran-3,5(4H,6H)-dione (CAS 1312340-84-3); 5-(Acetyloxy)-4-(4'-chloro-4-cyclopropyl-2'-fluoro[1,1'-biphenyl]-3-yl)-3,6-dihydro-2,2,6,6-tetramethyl-2H-pyran-3-one (CAS 1312337-48-6); 5-(Acetyloxy)-4-(2',4'-dichloro-4-cyclopropyl-[1,1'-biphenyl]-3-yl)-3,6-dihydro-2,2,6,6-tetramethyl-2H-pyran-3-one; 5-(Acetyloxy)-4-(4'-chloro-4-ethyl-2'-fluoro[1,1'-biphenyl]-3-yl)-3,6-dihydro-2,2,6,6-tetramethyl-2H-pyran-3-one (CAS 1312340-82-1); 5-(Acetyloxy)-4-(2',4'-dichloro-4-ethyl[1,1'-biphenyl]-3-yl)-3,6-dihydro-2,2,6,6-tetramethyl-2H-pyran-3-one (CAS 1033760-55-2); 4-(4'-Chloro-4-cyclopropyl-2'-fluoro[1,1'-bi-phenyl]-3-yl)-5,6-dihydro-2,2,6,6-tetramethyl-5-oxo-2H-pyran-3-ylcarbonic acid methyl ester (CAS 1312337-51-1); 4-(2',4'-Dichloro-4-cyclopropyl-[1,1'-biphenyl]-3-yl)-5,6-dihydro-2,2,6,6-tetramethyl-5-oxo-2H-pyran-3-ylcarbonic acid methyl ester; 4-(4'-Chloro-4-ethyl-2'-fluoro[1,1'-biphenyl]-3-yl)-5,6-dihydro-2,2,6,6-tetramethyl-5-oxo-2H-pyran-3-ylcarbonic acid methyl ester (CAS 1312340-83-2); 4-(2',4'-Dichloro-4-ethyl[1,1-biphenyl]-3-yl)-5,6-dihydro-2,2,6,6-tetramethyl-5-oxo-2H-pyran-3-ylcarbonic acid methyl ester (CAS 1033760-58-5); esprocarb, prosulfocarb, thiobencarb and triallate;

b2) from the group of the ALS inhibitors: bensulfuron-methyl, bispyribac-sodium, cyclosulfamuron, diclosulam, flumetsulam, flupyrsulfuron-methyl-sodium, foramsulfuron, imazamox, imazapic, imazapyr, imazaquin, imazethapyr, imazosulfuron, iodosulfuron, iodosulfuron-methyl-sodium, iofensulfuron, iofensulfuron-sodium, mesosulfuron, metazosulfuron, nicosulfuron, penoxsulam, propoxycarbazon-sodium, propyrisulfuron, pyrazosulfuron-ethyl, pyroxsulam, rimsulfuron, sulfosulfuron, thiencarbazon-methyl, tritosulfuron and triafamone;

b3) from the group of the photosynthesis inhibitors: ametryn, atrazine, diuron, fluometuron, hexazinone, isoproturon, linuron, metribuzin, paraquat, paraquat-dichloride, propanil, terbutryn and terbuthylazine;

b4) from the group of the protoporphyrinogen-IX oxidase inhibitors: acifluorfen, acifluorfen-sodium, butafenacil, cinidon-ethyl, carfentrazone-ethyl, flumioxazin, fluthiacet-methyl, fomesafen, lactofen, oxadiargyl, oxyfluorfen, saflufenacil, sulfentrazone, ethyl [3-[2-chloro-4-fluoro-5-(1-methyl-6-trifluoromethyl-2,4-dioxo-1,2,3,4-tetrahydropyrimidin-3-yl)phenoxy]-2-pyridyloxy]acetate (CAS 353292-31-6; S-3100), 3-[7-fluoro-3-oxo-4-(prop-2-ynyl)-3,4-dihydro-2H-benzo[1,4]oxazin-6-yl]-1,5-dimethyl-6-thioxo-[1,3,5]triazinan-2,4-dione, 1,5-dimethyl-6-thioxo-3-(2,2,7-trifluoro-3-oxo-4-(prop-2-ynyl)-3,4-dihydro-2H-benzo[1,4]oxazin-6-yl)-1,3,5-triazinane-2,4-dione (CAS 1258836-72-4), and 2-(2,2,7-Trifluoro-3-oxo-4-prop-2-ynyl-3,4-dihydro-2H-benzo[1,4]oxazin-6-yl)-4,5,6,7-tetrahydro-isoindole-1,3-dione, and 1-Methyl-6-trifluoromethyl-3-(2,2,7-trifluoro-3-oxo-4-prop-2-ynyl-3,4-dihydro-2H-benzo[1,4]oxazin-6-yl)-1H-pyrimidine-2,4-dione;

b5) from the group of the bleacher herbicides: clomazone, diflufenican, flurochloridone, isoxaflutole, mesotrione, picolinafen, sulcotrione, tefuryltrione, tembotrione, topramezone, bicyclopyrone, amitrole and flumeturon;

b6) from the group of the EPSP synthase inhibitors: glyphosate, glyphosate-isopropylammonium and glyphosate-trimesium (sulfosate);

b7) from the group of the glutamine synthase inhibitors: glufosinate, glufosinate-P and glufosinate-ammonium;

b9) from the group of the mitosis inhibitors: pendimethalin and trifluralin;

b10) from the group of the VLCFA inhibitors: acetochlor, cafenstrole, dimethenamid-P, fentrazamide, flufenacet, mefenacet, metazachlor, metolachlor, S-metolachlor, fenoxasulfone, ipfencarbazone and pyroxasulfone; likewise, preference is given to isoxazoline compounds of the formulae II.1, II.2, II.3, II.4, II.5, II.6, II.7, II.8 and II.9 as mentioned above;

b11) from the group of the cellulose biosynthesis inhibitors: isoxaben;

b13) from the group of the auxinic herbicides: 2,4-D and its salts and esters such as clacyfos, and aminocyclopyrachlor and its salts and esters, aminopyralid and its salts and its esters, clopyralid and its salts and esters, dicamba and its salts and esters, fluroxypyr-meptyl, quinclorac and quinmerac;

b14) from the group of the auxin transport inhibitors: diflufenzopyr and diflufenzopyr-sodium, b15) from the group of the other herbicides: dymron (=daimuron), indanofan, indaziflam, oxaziclomefone and triaziflam.

Moreover, it may be useful to apply the PPO-inhibiting herbicides, when used in combination with a compound B described SUPRA, in combination with safeners. Safeners are chemical compounds which prevent or reduce damage on useful plants without having a major impact on the herbicidal action of herbicides towards unwanted plants. They can be applied either before sowings (e.g. on seed treatments, shoots or seedlings) or in the pre-emergence application or post-emergence application of the useful plant.

Furthermore, the safeners C, the PPO-inhibiting herbicides and/or the herbicides B can be applied simultaneously or in succession.

Suitable safeners are e.g. (quinolin-8-oxy)acetic acids, 1-phenyl-5-haloalkyl-1H-1,2,4-triazol-3-carboxylic acids, 1-phenyl-4,5-dihydro-5-alkyl-1H-pyrazol-3,5-dicarboxylic acids, 4,5-dihydro-5,5-diaryl-3-isoxazol carboxylic acids, dichloroacetamides, alpha-oximinophenylacetonitriles, acetophenonoximes, 4,6-dihalo-2-phenylpyrimidines, N-[[4-(aminocarbonyl)phenyl]sulfonyl]-2-benzoic amides, 1,8-naphthalic anhydride, 2-halo-4-(haloalkyl)-5-thiazol carboxylic acids, phosphorthiolates and N-alkyl-O-phenyl-carbamates and their agriculturally acceptable salts and their agriculturally acceptable derivatives such amides, esters, and thioesters, provided they have an acid group.

Examples of preferred safeners C are benoxacor, cloquintocet, cyometrinil, cyprosulfamide, dichlormid, dicyclonon, dietholate, fenchlorazole, fenclorim, flurazole, fluxofenim, furilazole, isoxadifen, mefenpyr, mephenate, naphthalic anhydride, oxabetrinil, 4-(dichloroacetyl)-1-oxa-4-azaspiro [4.5]decane (MON4660, CAS 71526-07-3) and 2,2,5-trimethyl-3-(dichloroacetyl)-1,3-oxazolidine (R-29148, CAS 52836-31-4).

Especially preferred safeners C are benoxacor, cloquintocet, cyprosulfamide, dichlormid, fenchlorazole, fenclorim, flurazole, fluxofenim, furilazole, isoxadifen, mefenpyr, naphthalic anhydride, oxabetrinil, 4-(dichloroacetyl)-1-oxa-4-azaspiro[4.5]decane (MON4660, CAS 71526-07-3) and 2,2,5-trimethyl-3-(dichloroacetyl)-1,3-oxazolidine (R-29148, CAS 52836-31-4).

Particularly preferred safeners C are benoxacor, cloquintocet, cyprosulfamide, dichlormid, fenchlorazole, fenclorim, furilazole, isoxadifen, mefenpyr, naphthalic anhydride, 4-(dichloroacetyl)-1-oxa-4-azaspiro[4.5]decane (MON4660, CAS 71526-07-3), and 2,2,5-trimethyl-3-(dichloroacetyl)-1,3-oxazolidine (R-29148, CAS 52836-31-4).

Also preferred safeners C are benoxacor, cloquintocet, cyprosulfamide, dichlormid, fenchlorazole, fenclorim, furilazole, isoxadifen, mefenpyr, 4-(dichloroacetyl)-1-oxa-4-azaspiro[4.5]decane (MON4660, CAS 71526-07-3) and 2,2,5-trimethyl-3-(dichloroacetyl)-1,3-oxazolidine (R-29148, CAS 52836-31-4).

Particularly preferred safeners C, which, as component C, are constituent of the composition according to the invention are the safeners C as defined above; in particular the safeners C.1-C.12 listed below in table C:

TABLE C

| | Safener C |
|---|---|
| C.1 | benoxacor |
| C.2 | cloquintocet |
| C.3 | cyprosulfamide |
| C.4 | dichlormid |
| C.5 | fenchlorazole |
| C.6 | fenclorim |
| C.7 | furilazole |
| C.8 | isoxadifen |
| C.9 | mefenpyr |
| C.10 | naphtalic acid anhydride |
| C.11 | 4-(dichloroacetyl)-1-oxa-4-azaspiro[4.5]decane (MON4660, CAS 71526-07-3) |
| C.12 | 2,2,5-trimethyl-3-(dichloro-acetyl)-1,3-oxazolidine (R-29148, CAS 52836-31-4) |

The PPO-inhibiting herbicides (compounds A) and the active compounds B of groups b1) to b15) and the active compounds C are known herbicides and safeners, see, for example, The Compendium of Pesticide Common Names (alanwood.net/pesticides/); Farm Chemicals Handbook 2000 volume 86, Meister Publishing Company, 2000; B. Hock, C. Fedtke, R. R. Schmidt, Herbizide [Herbicides], Georg Thieme Verlag, Stuttgart 1995; W. H. Ahrens, Herbicide Handbook, 7th edition, Weed Science Society of America, 1994; and K. K. Hatzios, Herbicide Handbook, Supplement for the 7th edition, Weed Science Society of America, 1998. 2,2,5-Trimethyl-3-(dichloroacetyl)-1,3-oxazolidine [CAS No. 52836-31-4] is also referred to as R-29148. 4-(Dichloroacetyl)-1-oxa-4-azaspiro[4.5]decane [CAS No. 71526-07-3] is also referred to as AD-67 and MON 4660.

The assignment of the active compounds to the respective mechanisms of action is based on current knowledge. If several mechanisms of action apply to one active compound, this substance was only assigned to one mechanism of action.

Active compounds B and C having a carboxyl group can be employed in the form of the acid, in the form of an agriculturally suitable salt as mentioned above or else in the form of an agriculturally acceptable derivative in the compositions according to the invention.

In the case of dicamba, suitable salts include those, where the counterion is an agriculturally acceptable cation. For example, suitable salts of dicamba are dicamba-sodium, dicamba-potassium, dicamba-methylammonium, dicamba-dimethylammonium, dicamba-isopropylammonium, dicamba-diglycolamine, dicamba-olamine, dicamba-diolamine, dicamba-trolamine, dicamba-N,N-bis-(3-aminopropyl)methylamine and dicamba-diethylenetriamine. Examples of a suitable ester are dicamba-methyl and dicamba-butotyl.

Suitable salts of 2,4-D are 2,4-D-ammonium, 2,4-D-dimethylammonium, 2,4-D-diethylammonium, 2,4-D-diethanolammonium (2,4-D-diolamine), 2,4-D-triethanolammonium, 2,4-D-isopropylammonium, 2,4-D-triisopropanolammonium, 2,4-D-heptylammonium, 2,4-D-dodecylammonium, 2,4-D-tetradecylammonium, 2,4-D-triethylammonium, 2,4-D-tris(2-hydroxypropyl)ammonium, 2,4-D-tris(isopropyl)ammonium, 2,4-D-trolamine, 2,4-D-lithium, 2,4-D-sodium. Examples of suitable esters of 2,4-D are 2,4-D-butotyl, 2,4-D-2-butoxypropyl, 2,4-D-3-butoxypropyl, 2,4-D-butyl, 2,4-D-ethyl, 2,4-D-ethylhexyl, 2,4-D-isobutyl, 2,4-D-isooctyl, 2,4-D-isopropyl, 2,4-D-meptyl, 2,4-D-methyl, 2,4-D-octyl, 2,4-D-pentyl, 2,4-D-propyl, 2,4-D-tefuryl and clacyfos. Suitable salts of 2,4-DB are for example 2,4-DB-sodium, 2,4-DB-potassium and 2,4-DB-dimethylammonium. Suitable esters of 2,4-DB are for example 2,4-DB-butyl and 2,4-DB-isoctyl. Suitable salts of dichlorprop are for example dichlorprop-sodium, dichlorprop-potassium and dichlorprop-dimethylammonium. Examples of suitable esters of dichlorprop are dichlorprop-butotyl and dichlorprop-isoctyl.

Suitable salts and esters of MCPA include MCPA-butotyl, MCPA-butyl, MCPA-dimethylammonium, MCPA-diolamine, MCPA-ethyl, MCPA-thioethyl, MCPA-2-ethylhexyl, MCPA-isobutyl, MCPA-isoctyl, MCPA-isopropyl, MCPA-isopropylammonium, MCPA-methyl, MCPA-olamine, MCPA-potassium, MCPA-sodium and MCPA-trolamine.

A suitable salt of MCPB is MCPB sodium. A suitable ester of MCPB is MCPB-ethyl. Suitable salts of clopyralid are clopyralid-potassium, clopyralid-olamine and clopyralid-tris-(2-hydroxypropyl)ammonium. Example of suitable esters of clopyralid is clopyralid-methyl. Examples of a suitable ester of fluroxypyr are fluroxypyr-meptyl and fluroxypyr-2-butoxy-1-methylethyl, wherein fluroxypyr-meptyl is preferred.

Suitable salts of picloram are picloram-dimethylammonium, picloram-potassium, picloram-triisopropanolammonium, picloram-triisopropylammonium and picloram-trolamine. A suitable ester of picloram is picloram-isoctyl.

A suitable salt of triclopyr is triclopyr-triethylammonium. Suitable esters of triclopyr are for example triclopyr-ethyl and triclopyr-butotyl.

Suitable salts and esters of chloramben include chloramben-ammonium, chloramben-diolamine, chloramben-methyl, chloramben-methylammonium and chloramben-sodium. Suitable salts and esters of 2,3,6-TBA include 2,3,6-TBA-dimethylammonium, 2,3,6-TBA-lithium, 2,3,6-TBA-potassium and 2,3,6-TBA-sodium.

Suitable salts and esters of aminopyralid include aminopyralid-potassium and aminopyralid-tris(2-hydroxypropyl)ammonium.

Suitable salts of glyphosate are for example glyphosate-ammonium, glyphosate-diammonium, glyphoste-dimethylammonium, glyphosate-isopropylammonium, glyphosate-potassium, glyphosate-sodium, glyphosate-trimesium as well as the ethanolamine and diethanolamine salts, preferably glyphosate-diammonium, glyphosate-isopropylammonium and glyphosate-trimesium (sulfosate).

A suitable salt of glufosinate is for example glufosinate-ammonium.

A suitable salt of glufosinate-P is for example glufosinate-P-ammonium.

Suitable salts and esters of bromoxynil are for example bromoxynil-butyrate, bromoxynil-heptanoate, bromoxynil-octanoate, bromoxynil-potassium and bromoxynil-sodium.

Suitable salts and esters of ioxonil are for example ioxonil-octanoate, ioxonil-potassium and ioxonil-sodium.

Suitable salts and esters of mecoprop include mecoprop-butotyl, mecoprop-dimethylammonium, mecoprop-diolamine, mecoprop-ethadyl, mecoprop-2-ethylhexyl, mecoprop-isoctyl, mecopropmethyl, mecoprop-potassium, mecoprop-sodium and mecoprop-trolamine.

Suitable salts of mecoprop-P are for example mecoprop-P-butotyl, mecoprop-P-dimethylammonium, mecoprop-P-2-ethylhexyl, mecoprop-P-isobutyl, mecoprop-P-potassium and mecoprop-P-sodium.

A suitable salt of diflufenzopyr is for example diflufenzopyr-sodium.

A suitable salt of naptalam is for example naptalam-sodium.

Suitable salts and esters of aminocyclopyrachlor are for example aminocyclopyrachlor-dimethylammonium, aminocyciopyrachior-methyl, aminocyclopyrachlor-thisopropanolammonium, aminocyclopyrachlor-sodium and aminocyclopyrachlor-potassium.

A suitable salt of quinclorac is for example quinclorac-dimethylammonium.

A suitable salt of quinmerac is for example quinclorac-dimethylammonium.

A suitable salt of imazamox is for example imazamox-ammonium.

Suitable salts of imazapic are for example imazapic-ammonium and imazapic-isopropylammonium.

Suitable salts of imazapyr are for example imazapyr-ammonium and imazapyr-isopropylammonium.

A suitable salt of imazaquin is for example imazaquin-ammonium.

Suitable salts of imazethapyr are for example imazethapyr-ammonium and imazethapyr-isopropylammonium.

A suitable salt of topramezone is for example topramezone-sodium.

The preferred embodiments of the invention mentioned herein below have to be understood as being preferred either independently from each other or in combination with one another.

According to a preferred embodiment of the invention, the composition comprises as component B at least one, preferably exactly one herbicide B.

According to another preferred embodiment of the invention, the composition comprises at least two, preferably exactly two, herbicides B different from each other.

According to another preferred embodiment of the invention, the composition comprises at least three, preferably exactly three, herbicides B different from each other.

According to another preferred embodiment of the invention, the composition comprises as component. A at least one, preferably exactly one PPO-inhibiting herbicide, preferably acifluorfen, acifluorfen-sodium, butafenacil, cinidon-ethyl, carfentrazone-ethyl, flumioxazin, fluthiacet-methyl, fomesafen, lactofen, oxadiargyl, oxyfluorfen, saflufenacil, sulfentrazone, ethyl [3-[2-chloro-4-fluoro-5-(1-methyl-6-trifluoromethyl-2,4-dioxo-1,2,3,4-tetrahydropyrimidin-3-yl)-phenoxy]-2-pyridyloxy]acetate (CAS 353292-31-6; S-3100, 1,5-dimethyl-6-thioxo-3-(2,2,7-tri-fluoro-3-oxo-4-(prop-2-ynyl)-3,4-dihydro-2H-benzo[b][1,4]oxazin-6-yl)-1,3,5-triazinane-2,4-dione (CAS 1258836-72-4), especially preferred saflufenacil, 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), and as component B at least one, preferably exactly one, herbicide B.

According to another preferred embodiment of the invention, the composition comprises as component A at least one, preferably exactly preferably exactly one PPO-inhibiting herbicide, preferably acifluorfen, acifluorfen-sodium, butafenacil, cinidon-ethyl, carfentrazone-ethyl, flumioxazin, fluthiacet-methyl, fomesafen, lactofen, oxadiargyl, oxyfluorfen, saflufenacil, sulfentrazone, ethyl [3-[2-chloro-4-fluoro-5-(1-methyl-6-trifluoromethyl-2,4-dioxo-1,2,3,4-tetrahydropyrimidin-3-yl)phenoxy]-2-pyridyloxy]acetate (CAS 353292-31-6; 5-3100), 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), especially preferred saflufenacil, 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), and at least two, preferably exactly two, herbicides B different from each other.

According to another preferred embodiment of the invention, the composition comprises as component A at least one, preferably exactly preferably exactly one PPO-inhibiting herbicide, preferably acifluorfen, acifluorfen-sodium, butafenacil, cinidon-ethyl, carfentrazone-ethyl, flumioxazin, fluthiacet-methyl, fomesafen, lactofen, oxadiargyl, oxyfluorfen, saflufenacil, sulfentrazone, ethyl [3-[2-chloro-4-fluoro-5-(1-methyl-6-trifluoromethyl-2,4-dioxo-1,2,3,4-tetrahydropyrimidin-3-yl)phenoxy]-2-pyridyloxy]acetate (CAS 353292-31-6; S-3100), 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), especially preferred saflufenacil, 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4) and at least three, preferably exactly three, herbicides B different from each other.

According to another preferred embodiment of the invention, the composition comprises, in addition to a PPO-inhibiting herbicide, preferably acifluorfen, acifluorfen-sodium, butafenacil, cinidon-ethyl, carfentrazone-ethyl, flumioxazin, fluthiacet-methyl, fomesafen, lactofen, oxadiargyl, oxyfluorfen, saflufenacil, sulfentrazone, ethyl [3-[2-chloro-4-fluoro-5-(1-methyl-6-trifluoromethyl-2,4-dioxo-1,2,3,4-tetrahydropyrimidin-3-yl)phenoxy]-2-pyridyloxy]acetate (CAS 353292-31-6; S-3100), 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), especially preferred saflufenacil, 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), at least one and especially exactly one herbicidally active compound from group b1), in particular selected from the group consisting of clethodim, clodinafop-propargyl, cycloxydim, cyhalofop-butyl, fenoxaprop-P-ethyl, fluazifop, pinoxaden, profoxydim, quizalofop, sethoxydim, tepraloxydim, tralkoxydim, esprocarb, prosulfocarb, thiobencarb and triallate.

According to another preferred embodiment of the invention, the composition comprises, in addition to a PPO-inhibiting herbicide, preferably acifluorfen, acifluorfen-sodium, butafenacil, cinidon-ethyl, carfentrazone-ethyl, flumioxazin, fluthiacet-methyl, fomesafen, lactofen, oxadiargyl, oxyfluorfen, saflufenacil, sulfentrazone, ethyl [3-[2-chloro-4-fluoro-5-(1-methyl-6-trifluoromethyl-2,4-dioxo-1,2,3,4-tetrahydropyrimidin-3-yl)phenoxy]-2-pyridyloxy]acetate (CAS 353292-31-6; S-3100, 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4) especially preferred saflufenacil, 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), at least one and especially exactly one herbicidally active compound from group b2), in particular selected from the group consisting of bensulfuron-methyl, bispyribac-sodium, cloransulam-methyl, cyclosulfamuron, diclosulam, flumetsulam, flupyrsulfuron-methyl-sodium, foramsulfuron, halosulfuron-methyl, imazamox, imazapic, imazapyr, imazaquin, imazethapyr, imazosulfuron, iodosulfuron, iodosulfuron-methyl-sodium, mesosulfuron-methyl, metazosulfuron, nicosulfuron, penoxsulam, propoxycarbazon-sodium, pyrazosulfuron-ethyl, pyrithiobac-sodium, pyroxsulam, rimsulfuron, sulfosulfuron, thiencarbazon-methyl, thifensulfuron-methyl, trifloxysulfuron and tritosulfuron.

According to another preferred embodiment of the invention, the composition comprises, in addition to a a PRO-inhibiting herbicide, preferably acifluorfen, acifluorfen-sodium, butafenacil, cinidon-ethyl, carfentrazone-ethyl, flumioxazin, fluthiacet-methyl, fomesafen, lactofen, oxadiargyl, oxyfluorfen, saflufenacil, sulfentrazone, ethyl [3-[2-chloro-4-fluoro-5-(1-methyl-6-trifluoromethyl-2,4-dioxo-1,2,3,4-tetrahydropyrimidin-3-yl)phenoxy]-2-pyridyloxy] acetate (CAS 353292-31-6; S-3100), 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), especially preferred saflufenacil, 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), at least one and especially exactly one herbicidally active compound from group b3), in particular selected from the group consisting of ametryn, atrazine, bentazon, bromoxynil, diuron, fluometuron, hexazinone, isoproturon, linuron, metribuzin, paraquat, paraquat-dichloride, prometryne, propanil, terbutryn and terbuthylazine.

According to another preferred embodiment of the invention, the composition comprises, in addition to a a PRO-inhibiting herbicide, preferably acifluorfen, acifluorfen-sodium, butafenacil, cinidon-ethyl, carfentrazone-ethyl, flumioxazin, fluthiacet-methyl, fomesafen, lactofen, oxadiargyl, oxyfluorfen, saflufenacil, sulfentrazone, ethyl [3-[2-chloro-4-fluoro-5-(1-methyl-6-trifluoromethyl-2,4-dioxo-1,2,3,4-tetrahydropyrimidin-3-yl)phenoxy]-2-pyridyloxy] acetate (CAS 353292-31-6; S-3100), 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), especially preferred saflufenacil, 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), at least one and especially exactly one herbicidally active compound from group b4), in particular selected from the group consisting of acifluorfen, acifluorfen-sodium, azafenidin, bencarbazone, benzfendizone, bifenox, butafenacil, carfentrazone, carfentrazone-ethyl, chlomethoxyfen, cinidon-ethyl, fluazolate, flufenpyr, flufenpyr-ethyl, flumiclorac, flumiclorac-pentyl, flumioxazin, fluoroglycofen, fluoroglycofen-ethyl, fluthiacet, fluthiacet-methyl, fomesafen, halosafen, lactofen, oxadiargyl, oxadiazon, oxyfluorfen, pentoxazone, profluazol, pyraclonil, pyraflufen, pyraflufen-ethyl, saflufenacil, sulfentrazone, thidiazimin, tiafenacil, ethyl [3-[2-chloro-4-fluoro-5-(1-methyl-6-trifluoromethyl-2,4-dioxo-1,2,3,4-tetrahydropyrimidin-3-yl)phenoxy]-2-pyridyloxy]acetate (CAS 353292-31-6; S-3100), N-ethyl-3-(2,6-dichloro-4-trifluoromethylphenoxy)-5-methyl-1H-pyrazole-1-carboxamide (CAS 452098-92-9), N-tetrahydrofurfuryl-3-(2,6-dichloro-4-trifluoromethylphenoxy)-5-methyl-1 H-pyrazole-1-carboxamide (CAS 915396-43-9), N-ethyl-3-(2-chloro-6-fluoro-4-trifluoromethylphenoxy)-5-methyl-1H-pyrazole-1-carboxamide (CAS 452099-05-7), N-tetrahydrofurfuryl-3-(2-chloro-6-fluoro-4-trifluoromethylphenoxy)-5-methyl-1H-pyrazole-1-carboxamide (CAS 452100-03-7), 3-[7-fluoro-3-oxo-4-(prop-2-ynyl)-3,4-dihydro-2H-benzo[1,4]oxazin-6-yl]-1,5-dimethyl-6-thioxo-[1,3,5]triazinan-2,4-dione, 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), 2-(2,2,7-Trifluoro-3-oxo-4-prop-2-ynyl-3,4-dihydro-2H-benzo[1,4]oxazin-6-yl)-4,5,6,7-tetrahydro-isoindole-1,3-dione, 1-Methyl-6-trifluoromethyl-3-(2,2,7-trifluoro-3-oxo-4-prop-2-ynyl-3,4-dihydro-2H-benzo[1,4]oxazin-6-yl)-1H-pyrimidine-2,4-dione, methyl (E)-4-[2-chloro-5-[4-chloro-5-(difluoromethoxy)-1H-methyl-pyrazol-3-yl]-4-fluoro-phenoxy]-3-methoxy-but-2-enoate [CAS 948893-00-3], 3-[7-Chloro-5-fluoro-2-(trifluoromethyl)-1H-benzimidazol-4-yl]-1-methyl-6-(trifluoromethyl)-1H-pyrimidine-2,4-dione (CAS 212754-02-4).

According to another preferred embodiment of the invention, the composition comprises, in addition to a a PRO-inhibiting herbicide, preferably acifluorfen, acifluorfen-sodium, butafenacil, cinidon-ethyl, carfentrazone-ethyl, flumioxazin, fluthiacet-methyl, fomesafen, lactofen, oxadiargyl, oxyfluorfen, saflufenacil, sulfentrazone, ethyl [3-[2-chloro-4-fluoro-5-(1-methyl-6-trifluoromethyl-2,4-dioxo-1,2,3,4-tetrahydropyrimidin-3-yl)phenoxy]-2-pyridyloxy] acetate (CAS 353292-31-6; S-3100), 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), especially preferred saflufenacil, 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), at least one and especially exactly one herbicidally active compound from group b5), in particular selected from the group consisting of clomazone, diflufenican, flurochloridone, isoxaflutole, mesotrione, picolinafen, sulcotrione, tefuryltrione, tembotrione, topramezone, bicyclopyrone, amitrole and flumeturon.

According to another preferred embodiment of the invention, the composition comprises, in addition to a a PPO-inhibiting herbicide, preferably acifluorfen, acifluorfen-sodium, butafenacil, cinidon-ethyl, carfentrazone-ethyl, flumioxazin, fluthiacet-methyl, fomesafen, lactofen, oxadiargyl, oxyfluorfen, saflufenacil, sulfentrazone, ethyl [3-[2-chloro-4-fluoro-5-(1-methyl-6-trifluoromethyl-2,4-dioxo-1,2,3,4-tetrahydropyrimidin-3-yl)phenoxy]-2-pyridyloxy] acetate (CAS 353292-31-6; S-3100), 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), especially preferred saflufenacil, 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), at least one and especially exactly one herbicidally active compound from group b6), in particular selected from the group consisting of glyphosate, glyphosate-isopropylammonium and glyphosate-trimesium (sulfosate).

According to another preferred embodiment of the invention, the composition comprises, in addition to a a PPO-inhibiting herbicide, preferably acifluorfen, acifluorfen-sodium, butafenacil, cinidon-ethyl, carfentrazone-ethyl, flumioxazin, fluthiacet-methyl, fomesafen, lactofen, oxadiargyl, oxyfluorfen, saflufenacil, sulfentrazone, ethyl [3-[2-chloro-4-fluoro-5-(1-methyl-6-trifluoromethyl-2,4-dioxo-1,2,3,4-tetrahydropyrimidin-3-yl)phenoxy]-2-pyridyloxy] acetate (CAS 353292-31-6; S-3100), 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), especially preferred saflufenacil, 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), at least one and especially exactly one herbicidally active compound from group b7), in particular selected from the group consisting of glufosinate, glufosinate-P and glufosinate-ammonium.

According to another preferred embodiment of the invention, the composition comprises, in addition to a a PPO-inhibiting herbicide, preferably acifluorfen, acifluorfen-sodium, butafenacil, cinidon-ethyl, carfentrazone-ethyl, flumioxazin, fluthiacet-methyl, fomesafen, lactofen, oxadiargyl, oxyfluorfen, saflufenacil, sulfentrazone, ethyl [3-[2-chloro-4-fluoro-5-(1-methyl-6-trifluoromethyl-2,4-dioxo-1,2,3,4-tetrahydropyrimidin-3-yl)phenoxy]-2-pyridyloxy]acetate (CAS 353292-31-6; S-3100, 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4) especially preferred saflufenacil, 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), at least one and especially exactly one herbicidally active compound from group b9), in particular selected from the group consisting of pendimethalin and trifluralin.

According to another preferred embodiment of the invention, the composition comprises, in addition to a PPO-inhibiting herbicide, preferably acifluorfen, acifluorfen-sodium, butafenacil, cinidon-ethyl, carfentrazone-ethyl, flumioxazin, fluthiacet-methyl, fomesafen, lactofen, oxadiargyl, oxyfluorfen, saflufenacil, sulfentrazone, ethyl [3-[2-chloro-4-fluoro-5-(1-methyl-6-trifluoromethyl-2,4-dioxo-1,2,3,4-tetrahydropyrimidin-3-yl)phenoxy]-2-pyridyloxy]acetate (CAS 353292-31-6; S-3100, 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4)), especially preferred saflufenacil, 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), at least one and especially exactly one herbicidally active compound from group b10), in particular selected from the group consisting of acetochlor, cafenstrole, dimethenamid-P, fentrazamide, flufenacet, mefenacet, metazachlor, metolachlor, S-metolachlor, fenoxasulfone and pyroxasulfone. Likewise, preference is given to compositions comprising in addition to a a PPO-inhibiting herbicide, preferably acifluorfen, acifluorfen-sodium, butafenacil, cinidon-ethyl, carfentrazone-ethyl, flumioxazin, fluthiacet-methyl, fomesafen, lactofen, oxadiargyl, oxyfluorfen, saflufenacil, sulfentrazone, ethyl [3-[2-chloro-4-fluoro-5-(1-methyl-6-trifluoromethyl-2,4-dioxo-1,2,3,4-tetrahydropyrimidin-3-yl)phenoxy]-2-pyridyloxy]acetate (CAS 353292-31-6; S-3100), 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), especially preferred saflufenacil, 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), at least one and especially exactly one herbicidally active compound from group b10), in particular selected from the group consisting of isoxazoline compounds of the formulae II.1, II.2, II.3, II.4, II.5, II.6, II.7, II.8 and II.9, as defined above.

According to another preferred embodiment of the invention, the composition comprises, in addition to a PPO-inhibiting herbicide, preferably acifluorfen, acifluorfen-sodium, butafenacil, cinidon-ethyl, carfentrazone-ethyl, flumioxazin, fluthiacet-methyl, fomesafen, lactofen, oxadiargyl, oxyfluorfen, saflufenacil, sulfentrazone, ethyl [3-[2-chloro-4-fluoro-5-(1-methyl-6-trifluoromethyl-2,4-dioxo-1,2,3,4-tetrahydropyrimidin-3-yl)phenoxy]-2-pyridyloxy]acetate (CAS 353292-31-6; S-3100, 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), especially preferred saflufenacil, 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), at least one and especially exactly one herbicidally active compound from group b13), in particular selected from the group consisting of 2,4-D and its salts and esters, aminocyclopyrachlor and its salts and esters, aminopyralid and its salts such as aminopyralid-tris (2-hydroxypropyl)ammonium and its esters, clopyralid and its salts and esters, dicamba and its salts and esters, fluroxypyr-meptyl, quinclorac and quinmerac.

According to another preferred embodiment of the invention, the composition comprises, in addition to a PPO-inhibiting herbicide, preferably acifluorfen, acifluorfen-sodium, butafenacil, cinidon-ethyl, carfentrazone-ethyl, flumioxazin, fluthiacet-methyl, fomesafen, lactofen, oxadiargyl, oxyfluorfen, saflufenacil, sulfentrazone, ethyl [3-[2-chloro-4-fluoro-5-(1-methyl-6-trifluoromethyl-2,4-dioxo-1,2,3,4-tetrahydropyrimidin-3-yl)phenoxy]-2-pyridyloxy]acetate (CAS 353292-31-6; S-3100), 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), especially preferred saflufenacil, 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), at least one and especially exactly one herbicidally active compound from group b14), in particular selected from the group consisting of diflufenzopyr and diflufenzopyr-sodium.

According to another preferred embodiment of the invention, the composition comprises, in addition to a PPO-inhibiting herbicide, preferably acifluorfen, acifluorfen-sodium, butafenacil, cinidon-ethyl, carfentrazone-ethyl, flumioxazin, fluthiacet-methyl, fomesafen, lactofen, oxadiargyl, oxyfluorfen, saflufenacil, sulfentrazone, ethyl [3-[2-chloro-4-fluoro-5-(1-methyl-6-trifluoromethyl-2,4-dioxo-1,2,3,4-tetrahydropyrimidin-3-yl)phenoxy]-2-pyridyloxy]acetate (CAS 353292-31-6; S-3100), 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), especially preferred saflufenacil, 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), at least one and especially exactly one herbicidally active compound from group b15), in particular selected from the group consisting of dymron (=daimuron), indanofan, indaziflam, oxaziclomefone and triaziflam.

The term "binary compositions" includes compositions comprising one or more, for example 1, 2 or 3, active compounds of the PPO-inhibiting herbicide and either one or more, for example 1, 2 or 3, herbicides B.

In binary compositions comprising at least one PPO-inhibiting herbicide as component A and at least one herbicide B, the weight ratio of the active compounds A:B is generally in the range of from 1:1000 to 1000:1, preferably in the range of from 1:500 to 500:1, in particular in the range of from 1:250 to 250:1 and particularly preferably in the range of from 1:75 to 75:1.

In another aspect, the present invention refers to a method for growing the plant of the present invention while controlling weeds in the vicinity of said plant, said method comprising the steps of:

c) growing said plant; and d) applying a herbicide composition comprising a PPO-inhibiting herbicide to the plant and weeds, wherein the herbicide normally inhibits protoporphyrinogen oxidase, at a level of the herbicide that would inhibit the growth of a corresponding wild-type plant.

In another aspect, the present invention refers to a combination useful for weed control, comprising (a) a nucleic acid molecule of the present invention, which polynucleotide is capable of being expressed in a plant to thereby provide to that plant tolerance to a PPO inhibiting herbicide; and (b) a PPO inhibiting herbicide.

In another aspect, the present invention refers to a process for preparing a combination useful for weed control comprising (a) providing a nucleic acid molecule of the present invention, which nucleic acid molecule is capable of being expressed in a plant to thereby provide to that plant tolerance to a PPO inhibiting herbicide; and (b) providing a PPO inhibiting herbicide In a preferred embodiment, said step of providing a nucleic acid molecule comprises providing a plant containing said nucleic acid molecule.

In another preferred embodiment, said step of providing a nucleic acid molecule comprises providing a seed containing the nucleic acid molecule.

Preferably, said process further comprises a step of applying the PPO inhibiting herbicide to the seed.

In another aspect, the present invention refers to the use of a combination useful for weed control, comprising (a) a nucleic acid molecule of the present invention, which nucleic acid molecule is capable of being expressed in a plant to thereby provide to that plant tolerance to a PPO inhibiting herbicide; and (b) a PPO inhibiting herbicide, to control weeds at a plant cultivation site In other aspects, a method for treating a plant of the present invention is provided.

In some embodiments, the method comprises contacting the plant with an agronomically acceptable composition.

In another aspect, the present invention provides a method for preparing a descendent seed. The method comprises planting a seed of or capable of producing a plant of the present invention. In one embodiment, the method further comprises growing a descendent plant from the seed; and harvesting a descendant seed from the descendent plant. In other embodiments, the method further comprises applying a herbicidal composition to the descendent plant.

In another embodiment, the invention refers to harvestable parts of the transgenic plant according to the present invention. Preferably, the harvestable parts comprise the chimeric nucleic acid molecule or chimeric polypeptide of the present invention. The harvestable parts may be seeds, roots, leaves and/or flowers comprising the chimeric nucleic acid molecule or chimeric polypeptide or parts thereof. Preferred parts of soy plants are soy beans comprising the chimeric nucleic acid molecule or chimeric polypeptide.

In another embodiment, the invention refers to products derived from a plant according to the present invention, parts thereof or harvestable parts thereof. A preferred plant product is fodder, seed meal, oil, or seed-treatment-coated seeds. Preferably, the meal and/or oil comprises the chimeric polypeptide nucleic acids or chimeric polypeptides of the present invention.

In another embodiment, the invention refers to a method for the production of a product, which method comprises a) growing the plants of the invention or obtainable by the methods of invention and b) producing said product from or by the plants of the invention and/or parts, e.g. seeds, of these plants.

In a further embodiment the method comprises the steps a) growing the plants of the invention, b) removing the harvestable parts as defined above from the plants and c) producing said product from or by the harvestable parts of the invention.

The product may be produced at the site where the plant has been grown, the plants and/or parts thereof may be removed from the site where the plants have been grown to produce the product. Typically, the plant is grown, the desired harvestable parts are removed from the plant, if feasible in repeated cycles, and the product made from the harvestable parts of the plant. The step of growing the plant may be performed only once each time the methods of the invention is performed, while allowing repeated times the steps of product production e.g. by repeated removal of harvestable parts of the plants of the invention and if necessary further processing of these parts to arrive at the product. It is also possible that the step of growing the plants of the invention is repeated and plants or harvestable parts are stored until the production of the product is then performed once for the accumulated plants or plant parts. Also, the steps of growing the plants and producing the product may be performed with an overlap in time, even simultaneously to a large extend or sequentially. Generally the plants are grown for some time before the product is produced.

In one embodiment the products produced by said methods of the invention are plant products such as, but not limited to, a foodstuff, feedstuff, a food supplement, feed supplement, fiber, cosmetic and/or pharmaceutical. Foodstuffs are regarded as compositions used for nutrition and/or for supplementing nutrition. Animal feedstuffs and animal feed supplements, in particular, are regarded as foodstuffs.

In another embodiment the inventive methods for the production are used to make agricultural products such as, but not limited to, plant extracts, proteins, amino acids, carbohydrates, fats, oils, polymers, vitamins, and the like.

EXAMPLES

Example 1

Cloning of Expression Cassettes

All nucleic acid coding sequences encoding polypeptides comprising SEQ ID NO: 112, 113, 114, 115, 116, 117, 118, 119, 120, 121, 122, 123, 124, 125, 126, 127, 128, 129, 130, 131, 132, 133, 134, 136, 592, 593, 594, 595, 596, 597, 598, 599, 600, 601, 602, 603, 604, 605, 606, 607, 608, 609, 610, 611, 612, 613, 614, 615, 616, 617, 618, 619, 620, 621, 622, 623, or 624, are synthesized and cloned by Geneart (Geneart AG, Regensburg, Germany). Rational design mutants are synthesized by Geneart. Random PPO gene libraries are synthesized by Geneart. Plasmids are isolated from *E. coli* TOP10 by performing a plasmid minpreparation and confirmed by DNA sequencing.

Example 2

Engineering Herbicide Tolerant Plants Containing Expression Cassettes of the Present Invention Herbicide tolerant soybean (*Glyceine max*), corn (*Zea mays*), and canola (*Brassica napus* or *Brassica Rapa* var. or

*Brassica campestris* L.) plants are produced by a method as described by Olhoft et al. (US patent 2009/0049567). For transformation of soybean or *Arabidopsis thaliana*, Expression cassettes/constructs comprising chimeric nucleic acid molecules encoding polypeptides comprising SEQ ID NO: 112, 113, 114, 115, 116, 117, 118, 119, 120, 121, 122, 123, 124, 125, 126, 127, 128, 129, 130, 131, 132, 133, 134, 136, 592, 593, 594, 595, 596, 597. 598, 599, 600, 601, 602, 603, 604, 605, 606, 607, 608, 609, 610, 611, 612, 613, 614, 615, 616, 617, 618, 619, 620, 621, 622, 623, or 624, are cloned with standard cloning techniques as described in Sambrook et al. (Molecular cloning (2001) Cold Spring Harbor Laboratory Press) in a binary vector containing resistance marker gene cassette (AHAS) and chimeric polypeptide sequence (marked as GOI) in between ubiquitin promoter (PcUbi) and nopaline synthase terminator (NOS) sequence. For corn transformation, Wildtype or chimeric polypeptide sequences are cloned with standard cloning techniques as described in Sambrook et al. (Molecular cloning (2001) Cold Spring Harbor Laboratory Press) in a binary vector containing resistance marker gene cassette (AHAS) and chimeric polypeptide sequence (marked as GOI) in between corn ubiquitin promoter (ZmUbi) and nopaline synthase terminator (NOS) sequence. Binary plasmids are introduced to *Agrobacterium tumefaciens* for plant transformation. Plasmid constructs are introduced into soybean's axillary meristem cells at the primary node of seedling explants via *Agrobacterium*-mediated transformation. After inoculation and co-cultivation with Agrobacteria, the explants are transferred to shoot introduction media without selection for one week. The explants are subsequently transferred to a shoot induction medium with 1-3 μM imazapyr (Arsenal) for 3 weeks to select for transformed cells. Explants with healthy callus/shoot pads at the primary node are then transferred to shoot elongation medium containing 1-3 μM imazapyr until a shoot elongated or the explant died. Transgenic plantlets are rooted, subjected to TagMan analysis for the presence of the transgene, transferred to soil and grown to maturity in greenhouse. Transformation of corn plants are done by a method described by McElver and Singh (WO 2008/124495). Plant transformation vector constructs containing chimeric polypeptide sequences are introduced into maize immature embryos via *Agrobacterium*-mediated transformation.

Transformed cells are selected in selection media supplemented with 0.5-1.5 μM imazethapyr for 3-4 weeks. Transgenic plantlets are regenerated on plant regeneration media and rooted afterwards. Transgenic plantlets are subjected to TagMan analysis for the presence of the transgene before being transplanted to potting mixture and grown to maturity in greenhouse. *Arabidopsis thaliana* are transformed with wildtype or chimeric polypeptide sequences by floral dip method as decribed by McElver and Singh (WO 2008/124495). Transgenic *Arabidopsis* plants are subjected to TagMan analysis for analysis of the number of integration loci. Transformation of *Oryza sativa* (rice) are done by protoplast transformation as decribed by Peng et al. (U.S. Pat. No. 6,653,529) T0 or T1 transgenic plant of soybean, corn, and rice containing chimeric polypeptide sequences are tested for improved tolerance to herbicides in greenhouse studies and mini-plot studies with the following herbicides: trifludimoxazine, saflufenacil, flumioxazin, butafenacil, acifluorfen, lactofen, bifenox, sulfentrazone, and photosynthesis inhibitor diuron as negative control.

Example 3

Tissue Culture Conditions

An in vitro tissue culture mutagenesis assay has been developed to isolate and characterize plant tissue (e.g., maize, rice tissue) that is tolerant to protoporphyrinogen oxidase inhibiting herbicides, (trifludimoxazine, saflufenacil, flumioxazin, butafenacil, acifluorfen, lactofen, bifenox, sulfentrazone, and photosynthesis inhibitor diuron as negative control). The assay utilizes the somaclonal variation that is found in in vitro tissue culture. Spontaneous mutations derived from somaclonal variation can be enhanced by chemical mutagenesis and subsequent selection in a stepwise manner, on increasing concentrations of herbicide.

The present invention provides tissue culture conditions for encouraging growth of friable, embryogenic maize or rice callus that is regenerable. Calk are initiated from 4 different maize or rice cultivars encompassing *Zea mays* and Japonica (Taipei 309, Nipponbare, Koshihikari) and Indica (Indica 1) varieties, respectively. Seeds are surface sterilized in 70% ethanol for approximately 1 min followed by 20% commercial Clorox bleach for 20 minutes. Seeds are rinsed with sterile water and plated on callus induction media. Various callus induction media are tested. The ingredient lists for the media tested are presented in Table 1.

TABLE 1

| Ingredient | Supplier | R001M | R025M | R026M | R327M | R008M | MS711R |
|---|---|---|---|---|---|---|---|
| B5 Vitamins | Sigma | | | | | 1.0 X | |
| MS salts | Sigma | | | 1.0 X | 1.0 X | 1.0 X | 1.0 X |
| MS Vitamins | Sigma | | | 1.0 X | 1.0 X | | |
| N6 salts | Phytotech | 4.0 g/L | 4.0 g/L | | | | |
| N6 vitamins | Phytotech | 1.0 X | 1.0 X | | | | |
| L-Proline | Sigma | 2.9 g/L | 0.5 g/L | | | | 1.2 g/L |
| Casamino Acids | BD | 0.3 g/L | 0.3 g/L | 2 g/L | | | |
| Casein Hydrolysate | Sigma | | | | | | 1.0 g/L |
| L-Asp Monohydrate | Phytotech | | | | | | 150 mg/L |
| Nicotinic Acid | Sigma | | | | | | 0.5 mg/L |
| Pyridoxine HCl | Sigma | | | | | | 0.5 mg/L |
| Thiamine HCl | Sigma | | | | | | 1.0 mg/L |
| Myo-inositol | Sigma | | | | | | 100 mg/L |
| MES | Sigma | 500 mg/L | 500 mg/L | 500 mg/L | 500 mg/L | 500 mg/L | 500 mg/L |
| Maltose | VWR | 30 g/L | 30 g/L | 30 g/L | 30 g/L | | |
| Sorbitol | Duchefa | | | 30 g/L | | | |

TABLE 1-continued

| Ingredient | Supplier | R001M | R025M | R026M | R327M | R008M | MS711R |
|---|---|---|---|---|---|---|---|
| Sucrose | VWR | | | | | 10 g/L | 30 g/L |
| NAA | Duchefa | | | | | 50 µg/L | |
| 2,4-D | Sigma | 2.0 mg/L | | | | | 1.0 mg/L |
| MgCl$_2$•6H$_2$O | VWR | | | | | 750 mg/L | |
| →pH | | 5.8 | 5.8 | 5.8 | 5.8 | 5.8 | 5.7 |
| Gelrite | Duchefa | 4.0 g/L | | | | 2.5 g/L | |
| Agarose Type1 | Sigma | | 7.0 g/L | 10 g/L | 10 g/L | | |
| →Autoclave | | 15 min | 15 min | 15 min | 15 min | 15 min | 20 min |
| Kinetin | Sigma | | 2.0 mg/L | 2.0 mg/L | | | |
| NAA | Duchefa | | 1.0 mg/L | 1.0 mg/L | | | |
| ABA | Sigma | | 5.0 mg/L | | | | |
| Cefotaxime | Duchefa | | 0.1 g/L | 0.1 g/L | 0.1 g/L | | |
| Vancomycin | Duchefa | | 0.1 g/L | 0.1 g/L | 0.1 g/L | | |
| G418 Disulfate | Sigma | | 20 mg/L | 20 mg/L | 20 mg/L | | |

R001M callus induction media is selected after testing numerous variations. Cultures are kept in the dark at 30° C. Embryogenic callus is subcultured to fresh media after 10-14 days.

Example 4

Selection of Herbicide-Tolerant Calli

Once tissue culture conditions are determined, further establishment of selection conditions are established through the analysis of tissue survival in kill curves with trifludimoxazine, saflufenacil, phenylpyridines, flumioxazin, butafenacil, acifluorfen, lactofen, bifenox, sulfentrazone, and photosynthesis inhibitor diuron as negative control. Careful consideration of accumulation of the herbicide in the tissue, as well as its persistence and stability in the cells and the culture media is performed. Through these experiments, a sub-lethal dose has been established for the initial selection of mutated material. After the establishment of the starting dose of trifludimoxazine, saflufenacil, flumioxazin, butafenacil, acifluorfen, lactofen, bifenox, sulfentrazone, and photosynthesis inhibitor diuron as negative control in selection media, the tissues are selected in a step-wise fashion by increasing the concentration of the PPO inhibitor with each transfer until cells are recovered that grew vigorously in the presence of toxic doses. The resulting calli are further subcultured every 3-4 weeks to R001M with selective agent. Over 26,000 calli are subjected to selection for 4-5 subcultures until the selective pressure is above toxic levels as determined by kill curves and observations of continued culture. Alternatively, liquid cultures initiated from calli in MS711R with slow shaking and weekly subcultures. Once liquid cultures are established, selection agent is added directly to the flask at each subculture. Following 2-4 rounds of liquid selection, cultures are transferred to filters on solid R001M media for further growth.

Example 5

Regeneration of Plants

Tolerant tissue is regenerated and characterized molecularly for presence of chimeric nucleic acid molecules and/or biochemically for altered enzymatic activity in the presence of the selective agent. In addition, genes involved directly and/or indirectly in tetrapyrrole biosynthesis and/or metabolism pathways are also sequenced to characterize mutations. Finally, enzymes that change the fate (e.g. metabolism, translocation, transportation) are also sequence to characterized mutations. Following herbicide selection, calli are regenerated using a media regime of R025M for 10-14 days, R026M for ca. 2 weeks, R327M until well formed shoots are developed, and R008S until shoots are well rooted for transfer to the greenhouse. Regeneration is carried out in the light. No selection agent is included during regeneration. Once strong roots are established, M0 regenerants are transplant to the greenhouse in square or round pots. Transplants are maintained under a clear plastic cup until they are adapted to greenhouse conditions. The greenhouse is set to a day/night cycle of 27° C./21° C. (80° F./70° F.) with 600 W high pressure sodium lights supplementing light to maintain a 14 hour day length. Plants are watered according to need, depending in the weather and fertilized daily.

Example 6

Sequence Analysis

Leaf tissue is collected from clonal plants separated for transplanting and analyzed as individuals. Genomic DNA is extracted using a Wizard® 96 Magnetic DNA Plant System kit (Promega, U.S. Pat. Nos. 6,027,945 & 6,368,800) as directed by the manufacturer. Isolated DNA is PCR amplified using the appropriate forward and reverse primer.

PCR amplification is performed using Hotstar Taq DNA Polymerase (Qiagen) using touchdown thermocycling program as follows: 96° C. for 15 min, followed by 35 cycles (96° C., 30 sec; 58° C.-0.2° C. per cycle, 30 sec; 72° C., 3 min and 30 sec), 10 min at 72° C. PCR products are verified for concentration and fragment size via agarose gel electrophoresis. Dephosphorylated PCR products are analyzed by direct sequence using the PCR primers (DNA Landmarks, or Entelechon). Chromatogram trace files (.scf) are analyzed for mutation relative to the wild-type gene using Vector NTI Advance 10™ (Invitrogen). Based on sequence information, mutations are identified in several individuals. Sequence analysis is performed on the representative chromatograms and corresponding AlignX alignment with default settings and edited to call secondary peaks.

Example 7

Demonstration of Herbicide-Tolerance

T0 or T1 transgenic plant of soybean, corn, Canola varieties and rice containing the expression cassettes of the present invention encoding polypeptides comprising the sequences of SEQ ID NOs: 112, 113, 114, 115, 116, 117, 118, 119, 120, 121, 122, 123, 124, 125, 126, 127, 128, 129, 130, 131, 132, 133, 134, 136, 592, 593, 594, 595, 596, 597, 598, 599, 600, 601, 602, 603, 604, 605, 606, 607, 608, 609, 610, 611, 612, 613, 614, 615, 616, 617, 618, 619, 620, 621, 622, 623, or 624, are tested for improved tolerance to herbicides in greenhouse studies and mini-plot studies with the following herbicides: trifludimoxazine, saflufenacil, Phenylpyridine, flumioxazin, butafenacil, acifluorfen, lactofen, bifenox, sulfentrazone, S-3100, tiafenacil, and mixtures thereof, and photosynthesis inhibitor diuron as negative control. For the pre-emergence treatment, the herbicides are applied directly after sowing by means of finely distributing nozzles. The containers are irrigated gently to promote germination and growth and subsequently covered with transparent plastic hoods until the plants have rooted. This cover causes uniform germination of the test plants, unless this has been impaired by the herbicides. For post emergence treatment, the test plants are first grown to a height of 3 to 15 cm, depending on the plant habit, and only then treated with the herbicides. For this purpose, the test plants are either sown directly, and grown in the same containers or they are first grown separately and transplanted into the test containers a few days prior to treatment.

For testing of T0 plants, cuttings can be used. In the case of soybean plants, an optimal shoot for cutting is about 7.5 to 10 cm tall, with at least two nodes present. Each cutting is taken from the original transformant (mother plant) and dipped into rooting hormone powder (indole-3-butyric acid, IBA). The cutting is then placed in oasis wedges inside a bio-dome. Wild type cuttings are also taken simultaneously to serve as controls. The cuttings are kept in the bio-dome for 5-7 days and then transplanted to pots and then acclimated in the growth chamber for two more days. Subsequently, the cuttings are transferred to the greenhouse, acclimated for approximately 4 days, and then subjected to spray tests as indicated. Depending on the species, the plants are kept at 10-25° C. or 20-35° C. The test period extends over 3 weeks. During this time, the plants are tended and their response to the individual treatments is evaluated. Herbicide injury evaluations are taken at 2 and 3 weeks after treatment. Plant injury is rated on a scale of 0% to 100%, 0% being no injury and 100% being complete death. The results are shown in FIG. 20.

Transgenic *Arabidopsis thaliana* plants are assayed for improved tolerance to trifludimoxazine, saflufenacil, Phenylpyridine, flumioxazin, butafenacil, acifluorfen, lactofen, bifenox, sulfentrazone, 5-3100, tiafenacil, and mixtures thereof, and photosynthesis inhibitor diuron as negative control, in 48-well plates. Therefore, T2 seeds are surface sterilized by stirring for 5 min in ethanol+water (70+30 by volume), rinsing one time with ethanol+water (70+30 by volume) and two times with sterile, deionized water. The seeds are resuspended in 0.1% agar dissolved in water (w/v) Four to five seeds per well are plated on solid nutrient medium consisting of half-strength murashige skoog nutrient solution, pH 5.8 (Murashige and Skoog (1962) *Physiologia Plantarum* 15: 473-497), Compounds are dissolved in dimethylsulfoxid (DMSO) and added to the medium prior solidification (final DMSO concentration 0.1%). Multi well plates are incubated in a growth chamber at 22° C., 75% relative humidity and 110 µmol Phot*$m^{-2}$*$s^{-1}$ with 14:10 h light:dark photoperiod. Growth inhibition is evaluated seven to ten days after seeding in comparison to wild type plants.

Additionally, transgenic T1 *Arabidopsis* plants are tested for improved tolerance to herbicides in greenhouse studies with the following herbicides: trifludimoxazine, saflufenacil, Phenylpyridine, flumioxazin, butafenacil, acifluorfen, lactofen, bifenox, sulfentrazone, S-3100, tiafenacil, and mixtures thereof, and photosynthesis inhibitor diuron as negative control. The Results are shown in Table 2 and FIGS. 1-17.

TABLE 2

| SEQ ID NO. | Construct | Saflufenacil Tolerance Factor | Trifludimoxazine Tolerance Factor |
|---|---|---|---|
| 117 | hemG__tpFNR | 332 | 4433 |
| 119 | hemG__tpsAMATU__PPO2 | 1 | 1 |
| 118 | hemG__tplAMATU__PPO2 | 2200 | 9167 |
| 114 | hemF__tpFNR | 1 | 1 |
| 116 | hemF__tpsAMATU__PPO2 | 1 | 1 |
| 115 | hemF__tplAMATU__PPO2 | 1 | 1 |
| 123 | RHOMA__PPO__wt__tpFNR | 1 | 1 |
| 127 | RHOMA__PPO__wt__tpAMATU__PPO2 | 1 | 1 |
| 124 | RHOMA__PPO__F420V__tpFNR | 1 | 1 |
| 121 | OPITE__PPO__wt__tpFNR | 14 | 9 |
| 128 | CHLSP__PPO__wt__tpFNR | 640 | 1500 |

Additionally, transgenic T2 *Arabidopsis* plants are tested for improved tolerance to trifludimoxazine and saflufenacil in greenhouse studies. The Results are shown in FIGS. 18-19.

Additionally, various transgenic *Arabidopsis* plants were treated with various PPO inhibiting herbicides in greenhouse studies. The results are shown in Table 3, Table 4 and FIGS. 21-23.

TABLE 3

Herbicide injury evaluation 14 days after herbicide treatment. 100 = complete plant injury, 0 = no injury observed as compared to non-treated check

| | g ai/ha | Wildtype/non-trangenic | SEQ ID NO 119 A | SEQ ID NO 119 B | SEQ ID NO 117 I | SEQ ID NO 117 C | SEQ ID NO 118 Q | SEQ ID NO 118 R | SEQ ID NO 121 G | SEQ ID NO 121 H | SEQ ID NO 128 D | SEQ ID NO 128 E |
|---|---|---|---|---|---|---|---|---|---|---|---|---|
| Saflufenacil + | 300 | 100 | 100 | 100 | 95 | 97 | 68 | 48 | 100 | 100 | 97 | 97 |
| 1% MSO | 150 | 100 | 100 | 100 | 99 | 98 | 58 | 65 | 100 | 100 | 97 | 97 |
| | 50 | 100 | 100 | 100 | 94 | 100 | 55 | 5 | 100 | 100 | 93 | 97 |
| Trifludimoxazine + | 150 | 100 | 100 | 100 | 98 | 97 | 58 | 10 | 100 | 100 | 93 | 97 |
| 1% MSO | 75 | 100 | 100 | 100 | 99 | 93 | 50 | 23 | 100 | 100 | 93 | 95 |
| | 25 | 100 | 100 | 100 | 90 | 92 | 45 | 20 | 100 | 100 | 85 | 85 |
| Sulfentrazone + | 1120 | 100 | | | 98 | 98 | 48 | 40 | 100 | 100 | 95 | 95 |
| 1% MSO | 560 | 100 | | | 85 | 99 | 40 | 18 | 100 | 100 | 83 | 93 |
| | 280 | 100 | | | 89 | 83 | 25 | 15 | 100 | 100 | 73 | 70 |
| Flumioxazin + | 420 | 100 | | | 97 | 95 | 60 | 28 | 100 | 100 | 93 | 100 |
| 1% MSO | 280 | 100 | | | 94 | 95 | 60 | 28 | 100 | 100 | 94 | 99 |
| | 140 | 100 | | | 90 | 94 | 48 | 23 | 100 | 100 | 100 | 93 |
| Saflufenacil + | 300 + 150 | 100 | 100 | 100 | 100 | 97 | 65 | 63 | 100 | 100 | 98 | 97 |

TABLE 3-continued

Herbicide injury evaluation 14 days after herbicide treatment. 100 = complete plant injury, 0 = no injury observed as compared to non-treated check

|  | g ai/ha | Wildtype/non-trangenic | SEQ ID NO 119 A | SEQ ID NO 119 B | SEQ ID NO 117 I | SEQ ID NO 117 C | SEQ ID NO 118 Q | SEQ ID NO 118 R | SEQ ID NO 121 G | SEQ ID NO 121 H | SEQ ID NO 128 D | SEQ ID NO 128 E |
|---|---|---|---|---|---|---|---|---|---|---|---|---|
| Trifludimoxazine + | 150 + 75 | 100 | 100 | 100 | 95 | 97 | 60 | 58 | 100 | 100 | 95 | 98 |
| 1% MSO | 50 + 25 | 100 | 100 | 100 | 97 | 97 | 58 | 53 | 100 | 100 | 93 | 98 |
| Saflufenacil + | 300 + 1120 | 100 |  |  | 100 | 99 | 83 | 60 | 100 | 100 | 98 | 99 |
| Sulfentrazone + | 150 + 560 | 100 |  |  | 99 | 99 | 63 | 38 | 100 | 100 | 94 | 98 |
| 1% MSO | 50 + 280 | 100 |  |  | 97 | 97 | 58 | 28 | 100 | 100 | 95 | 97 |
| Saflufenacil + | 300 + 420 | 100 |  |  | 95 | 99 | 63 | 43 | 100 | 100 | 99 | 98 |
| Flumioxazin + | 150 + 280 | 100 |  |  | 99 | 95 | 65 | 55 | 100 | 100 | 100 | 98 |
| 1% MSO | 50 + 140 | 100 |  |  | 98 | 99 | 55 | 23 | 100 | 100 | 100 | 99 |
| Phenylpyridine + | 200 | 100 |  |  | 100 | 98 | 78 | 80 | 100 | 100 | 93 | 97 |
| 1% Dash | 100 | 100 |  |  | 99 | 100 | 78 | 73 | 100 | 100 | 97 | 97 |
|  | 50 | 100 |  |  | 98 | 95 | 70 | 65 | 100 | 100 | 93 | 90 |

TABLE 4

Herbicide injury evaluation 14 days after herbicide treatment. 100 = complete plant injury, 0 = no injury observed as compared to non-treated check

|  | Application number (2-4) and Rate (g ai/ha) | SEQ ID NO 120 J | SEQ ID NO 120 M | SEQ ID NO 118 Q | SEQ ID NO 118 R | Wildtype/non-transgenic |
|---|---|---|---|---|---|---|
| S3100 + MSO | (2) 200 + 1% | 80 | 89 | 65 | 53 | 100 |
|  | (3) 100 + 1% | 95 | 85 | 65 | 63 | 100 |
|  | (4) 50 + 1% | 75 | 97 | 65 | 60 | 100 |
|  | (2) 300 + 1% | 85 | 88 | 65 | 60 | 100 |
| Saflufenacil + | (3) 150 + 1% | 83 | 93 | 63 | 45 | 100 |
| MSO | (4) 50 + 1% | 80 | 95 | 63 | 38 | 100 |
| Trifludimoxazine + | (2) 150 + 1% | 98 | 93 | 65 | 50 | 100 |
| MSO | (3) 75 + 1% | 94 | 98 | 63 | 28 | 100 |
|  | (4) 25 + 1% | 80 | 94 | 60 | 18 | 100 |
| Saflufenacil + | (2) 300 + 150 + 1% | 95 | 98 | 65 | 70 | 100 |
| Trifludimoxazine + | (3) 150 + 75 + 1% | 88 | 85 | 68 | 40 | 100 |
| MSO | (4) 50 + 25 + 1% | 73 | 70 | 70 | 40 | 100 |
| Flumioxazin + | (2) 420 + 1% | 95 | 98 | 70 | 35 | 100 |
| MSO | (3) 280 + 1% | 85 | 98 | 65 | 60 | 100 |
|  | (4) 140 + 1% | 95 | 75 | 60 | 63 | 100 |

Example 8

Herbicide Selection Using Tissue Culture

Media is selected for use and kill curves developed as specified above. For selection, different techniques are utilized. Either a step wise selection is applied, or an immediate lethal level of herbicide is applied. In either case, all of the galli are transferred for each new round of selection. Selection is 4-5 cycles of culture with 3-5 weeks for each cycle. Cali are placed onto nylon membranes to facilitate transfer (200 micron pore sheets, Biodesign, Saco, Maine). Membranes are cut to fit 100×20 mm Petri dishes and are autoclaved prior to use 25-35 calli (average weight/calli being 22 mg) are utilized in every plate. In addition, one set of calli are subjected to selection in liquid culture media with weekly subcultures followed by further selection on semi-solid media. Mutant lines are selected using trifludimoxazine, saflufenacil, flumioxazin, butafenacil, acifluorfen, lactofen, bifenox, sulfentrazone, and photosynthesis inhibitor diuron as negative control. Efficiencies of obtaining mutants is high either based on a percentage of calli that gave rise to a regenerable, mutant line or the number of lines as determined by the gram of tissue utilized.

Example 9

Maize Whole Plant Transformation and PPO Inhibitor Tolerance Testing

Immature embryos are transformed according to the procedure outlined in Peng et al. (WO2006/136596). Plants are tested for the presence of the T-DNA by Taqman analysis with the target being the nos terminator which is present in all constructs. Healthy looking plants are sent to the greenhouse for hardening and subsequent spray testing. The plants are individually transplanted into MetroMix 360 soil in 4" pots. Once in the greenhouse (day/night cycle of 27oC/21oC with 14 hour day length supported by 600 W high pressure sodium lights), they are allowed to grow for 14 days. They are then sprayed with a treatment of 25 to 200 g ai/ha saflufenacil +1.0% v/v methylated seed oil (MSO) and/or 25-200 g ai/ha trifludimoxazineplus 1% MSO. Other PPO inhibiting herbicides are also tested in a similar fashion for confirming cross resistance: flumioxazin, butafenacil, acifluorfen, lactofen, bifenox, sulfentrazone, and photosynthesis inhibitor diuron as negative control. Herbicide injury evaluations are taken at 7, 14 and 21 days after treatment. Herbicide injury evaluations are taken 2, 7, 14 and 21 days post-spray to look for injury to new growth points and overall plant health. The top survivors are transplanted into gallon pots filled with MetroMix 360 for seed production.

Example 10

Soybean Transformation and PPO Inhibitor Tolerance Testing

Soybean cv Jake is transformed as previously described by Siminszky et al., Phytochem Rev. 5:445-458 (2006). After regeneration, transformants are transplanted to soil in small pots, placed in growth chambers (16 hr day/8 hr night; 25° C. day/23° C. night; 65% relative humidity; 130-150 microE m-2 s-1) and subsequently tested for the presence of the T-DNA via. Taqman analysis. After a few weeks, healthy, transgenic positive, single copy events are transplanted to larger pots and allowed to grow in the growth chamber. An optimal shoot for cutting is about 3-4 inches tall, with at least two nodes present. Each cutting is taken from the original transformant (mother plant) and dipped into rooting hormone powder (indole-3-butyric acid, IBA). The cutting is then placed in oasis wedges inside a bio-dome. The mother plant is taken to maturity in the greenhouse and harvested for seed. Wild type cuttings are also taken simultaneously to serve as negative controls. The cuttings are kept in the bio-dome for 5-7 days and then transplanted to 3 inch pots and then acclimated in the growth chamber for two more days. Subsequently, the cuttings are transferred to the greenhouse, acclimated for approximately 4 days, and then sprayed with a treatment of 0-200 g al/ha saflufenacil plus 1% MSO and/or 25-200 g ai/ha trifludimoxazine plus 1% MSO. Other PPO inhibiting herbicides are also tested in a similar fashion for confirming cross resistance: flumioxazin, butafenacil, acifluorfen, lactofen, bifenox, sulfentrazone, and photosynthesis inhibitor diuron as negative control. Herbicide injury evaluations are taken at 2, 7, 14 and 21 days after treatment. Results are shown in FIG. 20.

| Rating | Phenotype (phytotoxicity) of surviving plants |
|---|---|
| 1 | no obvious damage (no phytotoxicity) |
| 2 | minor amount of leaf damage, plant will survive |
| 3 | moderate amount of leaf damage, plant will survive |
| 4 | severe amount of leaf damage, plant will survive |
| 5 | no surviving plants - all plants dead/dying |

The following gives a definition of the injury scores measured above:

| Score | Description of injury |
|---|---|
| 0 | No Injury |
| 1 | Minimal injury, only a few patches of leaf injury or chlorosis. |
| 2 | Minimal injury with slightly stronger chlorosis. Overall growth points remain undamaged. |
| 3 | Slightly stronger injury on secondary leaf tissue, but primary leaf and growth points are still undamaged. |
| 4 | Overall plant morphology is slightly different, some chlorosis and necrosis in secondary growth points and leaf tissue. Stems are intact. Regrowth is highly probable within 1 week. |
| 5 | Overall plant morphology is clearly different, some chlorosis and necrosis on a few leaves and growth points, but primary growth point is intact. Stem tissue is still green. Regrowth is highly probable within 1 week. |
| 6 | Strong injury can be seen on the new leaflet growth. Plant has a high probability to survive only through regrowth at different growth points. Most of the leaves are chlorotic/necrotic but stem tissue is still green. May have regrowth but with noticeable injured appearance. |
| 7 | Most of the active growth points are necrotic. There may be a single growth point that could survive and may be partially chlorotic or green and partially necrotic. Two leaves may still be chlorotic with some green; the rest of the plant including stem is necrotic. |
| 8 | Plant will likely die, and all growth points are necrotic. One leaf may still be chlorotic with some green. The remainder of the plant is necrotic. |
| 9 | Plant is dead. |

\* Not tested

Example 14

Transient Protein Expression in Tobacco Leafs

Transient expression of chimeric polypeptide sequences (e.g. SEQ ID NOs: 112, 113, 114, 115, 116, 117, 118, 119, 120, 121, 122, 123, 124, 125, 126, 127, 128, 129, 130, 131, 132, 133, 134, 136, 592, 593, 594, 595, 596, 597, 598, 599, 600, 601, 602, 603, 604, 605, 606, 607, 608, 609, 610, 611, 612, 613, 614, 615, 616, 617, 618, 619, 620, 621, 622, 623, or 624) can be done as described previously (Voinnet O., et al., 2003, The Plant Journal 33, 949-956). In brief, cloning of GOI and *Agrobacterium* transformation (strain: GV2260) is done as described in EXAMPLE 5. Young leaves of *Nicotiana benthamiana* are infiltrated with transgenic *Agrobacterium* suspension ($OD^{600}$ of 1.0) harboring binary vector constructs containing a GOI gene controlled by a promoter and terminator sequence. 48 h to 72 h after infiltration punches of leave discs (0.75 cm in diameter) are transferred to 6-well plates with medium (half strength Linsmaier-Skoog (Linsmaier and Skoog (1965) Physiol. Plant. 18: 100-127) nutrient solution or water) containing herbicide of interest in different concentrations. Multi well plates are incubated in a growth chamber at 22° C., 75% relative humidity and 110 μmol Phot*$m^{-2}$*$s^{-1}$ with 14:10 h light: dark photoperiod.

Example 15

Demonstration of Herbicide Tolerance of Transiently Transformed Tobacco Leaf Discs Leaf discs, generated as described in EXAMPLE 14, expressing a protein encoded by GOI, are subjected to analysis on improved tolerance to herbicide treatment. For analysis of herbicide damage, chlorophyll fluorescence are identified as indicative marker (Dayan and Zaccaro (2012) Pest. Biochem. Physiol, 102: 189-197). In addition to monitor herbicide effect by visual inspection the photosynthetic yield of photosystem II are done with a MAXI imaging PAM machine (IMAGINE-PAM M-Series, Walz, Effeltrich, Germany) 48 h after starting herbicide treatment. PSII yield are measured as per manufacturer instructions. Tolerance factors are calculated based on $IC_{50}$ values of PSII yield inhibition of transformed versus empty vector-transformed leaf discs. $IC_{50}$ of PSII yield inhibition in empty vector-transformed leaf discs treated with Saflufenacil or trifludimoxazine for 48 h was measured with $1.1*10^{-7}$ M or $1.1*10^{8}$ M, respectively.

SEQUENCE LISTING (624 sequences)

SEQ ID NO: 1 - protein, 98 aa, Amaranthus
MVIQSITHLSPNLALPSPLSVSTKNYPVAVMGNISEREEPTSAKRVAVVGAGVSGLAAAYKLKSHGLSVTLFEADSRAGGKLKTVKKDGFIWDEGANT

SEQ ID NO: 2 - protein, 98 aa, Amaranthus
MVIQSITHLSPNLALPSPLSVSTKNYPVAVMGNISEREEPTSAKRVAVVGAGVSGLAAAYKLKSHGLSVTLFEANSRAGGKLKTVKKDGFIWDEGANT

SEQ ID NO: 3 - protein, 98 aa, Amaranthus
MVIQSITHLSPKLALPSPLSVSTKNYPVAVMGNISEREEPTSAKRVAVVGAGVSGLAAAYKLKSHGLNVTLFEADSRAGGKLKTVKKDGFIWDEGANT

SEQ ID NO: 4 - protein, 98 aa, Amaranthus; identical to SEQ ID NO: 3

SEQ ID NO: 5 - protein, 113 aa, Echinochloa
MLTLLFGVTSAGRATMVIQSTTHLSPNLALPSPLSVSTKNYPVAVMGNISEREEPTSAKRVAVVGAGVSGLAAAYKLKSHGLSVTLFEADSRAGGKLKTVKKDGFIWDEGANT

SEQ ID NO: 6 - protein, 97 aa, Spinacia oleracea
MVILPVSQLSTNLGLSLVSPTKNNPVMGNVSERNQVNQPISAKRVAVVGAGVSGLAAAYKLKSNGLNVTLFEADSRAGGKLKTVVKDGLIWDEGANT

SEQ ID NO: 7 - protein, 96 aa, Beta vulgaris subsp. vulgaris
MVMLYDSHLSGVSTHLQLSQAFPRKNPLMAKVSEPGKPTSAKRIAVVGAGVSGLAAAYKLKSHGLSVTLFEADTRAGGKLKTVAKDGLIWDEGANT

SEQ ID NO: 8 - protein, 94 aa, Solanum tuberosum
MAPSAGEDKQSNLLYPHVSLHNSTISQAKLTQFFCVDCPKRVAVIGAGVSGLAAAYKLKIHGLDVTVFEAEGRAGGKLRSLSQDGLIWDEGANT

SEQ ID NO: 9 - protein, 88 aa, Gossypium
MLNIAPSCVLASGISKPVTKMASTENKDDHSSAKRVAVIGAGVSGLAAAYKLKSQGLHVTVFESEGRAGGKLRSVSREGLIWDEGANT

SEQ ID NO: 10 - protein, 122 aa, Eucalyptus
MTGSTICSWKTRTVDGPNPELWSARRRRPPLSSLSISIGKPEQRGAHGQQRHAKMSSAAGADISSKTLHALSSSQLTYGLAAAHKLKSNGVDVTVYEAEGRIGGKLRSVSQGGLIWDEGANT

SEQ ID NO: 11 - protein, 72 aa, Coffea
MASPAPKEKDKSSTCTKKRVAVVGAGVSGLAAAYKLKLRGLNVTVFEADERAGGKLKSVSRDGLIWDEGANT

SEQ ID NO: 12 - protein, 71 aa, Arabidopsis thaliana
MASGAVADHQIEAVSGKRVAVVGAGVSGLAAAYKLKSRGLNVTVFEADGRVGGKLRSVMQNGLIWDEGANT

SEQ ID NO: 13 - protein, 68 aa, Helianthus annuus
MASPTTPDNQKPAKRVAVVGAGVSGCAAAYKLKLHGLNVTVFEADGRVGGKLRSVSQDGLIWDEGANT

SEQ ID NO: 14 - protein, 73 aa, Arabidopsis lyrata
MESGAVGDHDTKFESISGKRVAVVGAGVSGLAAAYKLKSRGLNVTVFEADERAGGKLTSVMQNGLIWDQGANT

SEQ ID NO: 15 - protein, 99 aa, Erythranthe
MRLYSAQYCCPSLLLLSSPSPYPFPITRSTVLSMASAAQQDSAVKSVAVIGAGVSGLSAAYKLKLHGLNVTVFEADARSGGKLRSISHDGLIWDEGANT

SEQ ID NO: 16 - protein, 69 aa, Brassica oleracea
MASNAAADHDKLSGKRVAVVGAGVSGLAAAYKLKSKGVNVTLFEADGRVGGKLRSVMHNGLIWDEGANT

SEQ ID NO: 17 - protein, 68 aa, Ambrosia artemisiifolia
MASPTIVDNQKPAKRVAIVGAGVSGCAAAYKLKLHGLNVTVFEADERVGGKPRSVSQDGLIWDEGANT

SEQ ID NO: 18 - protein, 71 aa, Morus notabilis
MGTSASKQDNPTSPVKSVAVIGAGVSGLAAAYKLKSHGLNVTVFEAEERAGGKLRSVSSHHGLIWDEGANT

SEQ ID NO: 19 - protein, 63 aa, Cucumis sativus
MKSSQSSRKKVAVVGAGVSGLAAAYKLKSHGFDVTVLEADERVGGKLRSVSYKGLIWDEGANT

SEQ ID NO: 20 - protein, 72 aa, Zostera marina
MSLPAMSEISCISTGPAHSVAVVGGGISGLAAAYKLKSNGLSVTVFETEERPGGKIRSRSQDGFIWDEGANT

SEQ ID NO: 21 - protein, 77 aa, Chondrus crispus
MAVAEGATPAPAAASATPSEVDALVIGSGISGSSLAFTLSQASPATSLLLTEARPVVGGNVISRNERGYTWEEGPNT

SEQ ID NO: 22 - protein, 66 aa, Chondrus crispus
MPEPVKRNVAVLGGGPAGLSAAFRLLHDLPPGLSVKVDLYEATGRLGGAVTSACDAGFCYELGPNS

SEQ ID NO: 23 - protein, 109 aa, Oryza nivara
MLSPATTFSSSSSSSSPSRAHARAPTRFAVVASARAARFRPARAMAASDDPRGGRSVAVVGAGVSGLAAAYRLRKRGVQVTVFEAADRAGGKIRTNSEGGFIWDEGANT

SEQ ID NO: 24 - protein, 108 aa, Oryza glumipatula
MLSPATTFSSSSSSSPSRAHAHAPTRFAVAASARAARFRPARAMAASDDPRGGRSVAVVGAGVSGLAAAYRLRKRGVQVTVFEAADRAGGKIRTNSEGGFIWDEGANT

SEQ ID NO: 25 - protein, 65 aa, Oryza
MAASDDPRGGRSVAVVGAGVSGLAAAYRLRKRGVQVTVFEAADRAGGKIRTNSEGGFIWDEGANT

SEQ ID NO: 26 - protein, 109 aa, Oryza sativa
MLSPATTFSSSSSSSSPSRAHARAPTRFAVAASARAARFRPARAMAASDDPRGGRSVAVVGAGVSGLAAAYRLRKRGVQVTVFEAADRAGGKIRTNSEGGFIWDEGANT

SEQ ID NO: 27 - protein, 114 aa, Oryza sativa
MAAAAAAMATATSATAAPPLRIRDAARRTRRRGHVRCAVASGAAEAPAAPGARVSADCVVVGGGISGLCTAQALATKHGVGDVLVTEARARPGGNITTAERAGEGYLWEEGPNS

SEQ ID NO: 28 - protein, 110 aa, Oryza punctata
MLSPATTTTFSSSSSSSSSSSRAHAPTRFAAAASARAARFRPARAMAASDDPHGGRSVAVVGAGVSGLAAAYRLRKRGVQVTVFEAADRAGGKIRTNSEGGFIWDEGANT

SEQ ID NO: 29 - protein, 108 aa, Oryza rufipogon
MLSPATTFSSSSSSSPSRAHARAPTRFAVAASARAARFRPARAMAASDDPRGGRSVAVVGAGVSGLAAAYRLRKRGVQVTVFEAADRAGGKIRTNSEGGFIWDEGANT

SEQ ID NO: 30 - protein, 113 aa, Oryza meridionalis
MLSPATATTTTTTTFSSSSSPSRAHAHASTRFAVAASARAARFRPARAMAASNDPRGGRSVAVVGAGVSGLAAAYRLRKRGVQVTVFEAADRAGGKIRTNSEGGFIWDEGANT

SEQ ID NO: 31 - protein, 100 aa, Zea mays
MLALTASASSASSHPYRHASAHTRRPRLRAVLAMAGSDDPRAAPARSVAVVGAGVSGLAAAYRLRQSGVNVTVFEAADRAGGKIRTNSEGGFVWDEGANT

SEQ ID NO: 32 - protein, 109 aa, Oryza brachyantha
MLSPAATTTTTTSYCSYSSRAHAPTRSASAGAARFRPARAMATSDNDPRGAAPARSVAVVGAGVSGLAAAYKLRKRGVQVTVFEAADRAGGKIRTNSESGFIWDEGANT

SEQ ID NO: 33 - protein, 131 aa, Musa acuminata
MLKQHGSATNRGLLSKIWFARRFGEPVCRDPILLFRLPLDLGRSRRRRCSRKPSCFGEFHRQLAIAMASADNHNSIKSVAVVGGGVSGLAAAYKLKSNGLKVTLFEAEERAGGKIKSSSENGLIWDEGANT

SEQ ID NO: 34 - protein, 70 aa, Populus trichocarpa
MTAAAKDDDFGSKQSKNVAVIGAGVSGLAAAYKLKSNGVKVTVFEAEGRAGGKLRSVSHHDLVWDEGANT

SEQ ID NO: 35 - protein, 108 aa, Avena fatua
MLASATTPSPSSSRASTLFASSSRPRHTASARGRRLRPVLAMAASDDPRAAPARSVAVVGAGVSGLVAAYRLRKSGVRVTVFEADDRAGGKIRTNSDSGFLWDEGANT

SEQ ID NO: 36 - protein, 98 aa, Setaria italica
MLSSSTTTASPASSHPYRPAYPRASLRPVLAMAGSDDPRAAPARSVAVIGAGVSGLAAAYRLRKSGVNVTVFEAADRAGGKIRTNSEAGFLWDEGANT

SEQ ID NO: 37 - protein, 108 aa, Poa annua
MLTSATTPSSSSSASSRACARFASSARPHHTASARGRRLRPVLAMAASDQPRARSVAVVGAGVSGLVAAYRLRKSGVRVTVFEADDRAGGKIRTNSDSGFLWDEGANT

SEQ ID NO: 38 - protein, 100 aa, Sorghum bicolor
MLARTATVSSTSSHSHPYRPTSARSLRLRPVLAMAGSDDSRAAPARSVAVVGAGVSGLVAAYRLRKSGVNVTVFEAADRAGGKIRTNSEGGFLWDEGANT

SEQ ID NO: 39 - protein, 104 aa, Brachypodium distachyon
MLTSATASPSASTRFSSTCRPCRSDSVPARRPRPVLAMAASDDPRAAPARSVAVVGAGVSGLVAAHRLRKSGVRVTVFEADDRAGGKIRTNSDSGFLWDEGANT

SEQ ID NO: 40 - protein, 107 aa, Alopecurus myosuroides
MLTSATTPSSSSASSRASTRFASSSRPRRTASARGRRLRPVLAMAASDDPRARSVAVVGAGVSGLVAAYRLSKSGVRVTVFEADDRAGGKIRTNSDSGFLWDEGANT

SEQ ID NO: 41 - protein, 68 aa, Gossypium raimondii
MASTENKDDHSSAKRVAVIGAGVSGLAAAYKLKSQGLHVTVFESEGRAGGKLRSVSREGLIWDEGANT

SEQ ID NO: 42 - protein, 68 aa, Amaranthus tuberculatus
MGNISERDEPTSAKRVAVVGAGVSGLAAAYKLKSHGLNVTLFEADSRAGGKLKTVKKDGFIWDEGANT

SEQ ID NO: 43 - protein, 68 aa, Amaranthus tuberculatus; identical to SEQ ID NO: 42

SEQ ID NO: 44 - protein, 70 aa, Brassica rapa
MASNAVADHDKPVSGKRVAVVGAGVSGLAAAYKLKSKGVNVTVFEADGRVGGKLRSVMHNGLIWDEGANT

SEQ ID NO: 45 - protein, 70 aa, Jatropha curcas
MASAPKDERRNPSSGKRVAVVGAGVSGLAAAYKLKSHGLKVTVFEAEGRAGGKLRSVSRDGLIWDEGANT

SEQ ID NO: 46 - protein, 70 aa, Vitis vinifera
MAEKSDAQSHYNGSGKRVAVVGAGVSGLAAAYKLKLHGVNITLYEAEERAGGKLRSVSQHGLVWDEGANT

SEQ ID NO: 47 - protein, 69 aa, Vitis vinifera
MAEKSDAQSHYNGSGKRVAVVGAGVSGLAAAYKLKLHGVNTLYEAEERAGGKLRSVSQHGLVWDEGANT

SEQ ID NO: 48 - protein, 69 aa, Ricinus communis
MSSVIKEDRNPSHVKRVAVVGAGVSGLAAAYKLKSHGLKVTVFEAEERAGGKLRSVNHDGLIWDEGANT

SEQ ID NO: 49 - protein, 65 aa, Solanum lycopersicum
MAPSAGEDKQKRVAVIGAGVSGLAAAYKLKVHGLNVTVFEAEGRAGGKLRSLSQDGLIWDEGANT

SEQ ID NO: 50 - protein, 64 aa, Kochia
MADLSETSVKRVAVVGAGVSGLAAAYKLKSHGFNVTLFEAEPRAGGKIKTVAKDGLIWDEGANT

SEQ ID NO: 51 - protein, 66 aa, Prunus persica
MTSLTTKEGSVKRVAVVGAGVSGLAAAYKLKSHGFDVTVFEAEGRAGGKLRSVSHDGLIWDEGANT

SEQ ID NO: 52 - protein, 68 aa, Theobroma cacao
MAAAKNKDKQTSAKRVAVVGAGVSGLAAAYKLKSHGLNVTMFEAEGRAGGKLRSVSQEGLIWDEGANT

SEQ ID NO: 53 - protein, 68 aa, Glycine max
MASSATDDNPRSVKRVAVVGAGVSGLAAAYKLKSHGLDVTVFEAEGRAGGRLRSVSQDGLIWDEGANT

SEQ ID NO: 54 - protein, 68 aa, Citrus clementina
MASAPGEDNQRSAKRVAVVGAGVSGLAAAYKLKSNGVNVMVFEADERAGGKLRSISKDGLIWDEGANT

SEQ ID NO: 55 - protein, 68 aa, Citrus clementina
MTNKWRVDFSGSAKRVAVVGAGVSGLAAAYKLKSNGVNVMVFEADERAGGKLRSISKDGLIWDEGANT

SEQ ID NO: 56 - protein, 68 aa, Medicago truncatula
MASSAKDDNPRSVKRVAVVGAGVSGLAAAYKLKSHGLDVTVFEAEGRAGGRLRTVSRDGLVWDEGANT

SEQ ID NO: 57 - protein, 68 aa, Phaseolus vulgaris
MSSSATDDNPRSVKRVAVIGAGVSGLAAAYKLKSHGLDVTVFEAEGRAGGRLRSVSRDGLIWDEGANT

SEQ ID NO: 58 - protein, 68 aa, Vigna angularis
MSSSATDDNPRSVKRVAVIGAGVSGLAAAYKLKSHGVDVTVFEAEGRAGGRLRSVSRDGLIWDEGANT

SEQ ID NO: 59 - protein, 68 aa, Gossypium arboreum
MASTENKDDHSSAKRVAVIGAGVSGLAAAYKLKSQGLHVTVFESEGRAGGKLRSVSRDGLIWDEGANT

SEQ ID NO: 60 - protein, 68 aa, Nicotiana tabacum
MAPSAGEDKHSSAKRVAVIGAGVSGLAAAYKLKIHGLNVTVFEAEGKAGGKLRSVSQDGLIWDEGANT

SEQ ID NO: 61 - protein, 68 aa, Ambrosia artemisiifolia
MASPTIVDNQKPAKRVAIVGAGVSGCAAAYKLKLHGLNVTVFEADGRVGGKLRSVSQDGLIWDEGANT

SEQ ID NO: 62 - protein, 68 aa, Solanum tuberosum
MAPSAGEDKQNCPKRVAVIGAGVSGLAAAYKLKIHGLNVTVFEAEGRAGGKLRSLSQDGLIWDEGANT

SEQ ID NO: 63 - protein, 68 aa, Solanum tuberosum
MAPSAGEDKQNCPKRVAVIGAGVSGLAAAYKLKIHGLDVTVFEAEGRAGGKLRSLSQDGLIWDEGANT

SEQ ID NO: 64 - protein, 69 aa, Brassica napus
MASNAAADHDKLSGKRVAVVGAGVSGLAAAYKLKSKGVNVTVFEADGRVGGKLRSVIRNGLIWDEGANT

SEQ ID NO: 65 - protein, 69 aa, Brassica napus
MASNAVADHDKLSGKRVAVVGAGVSGLAAAYKLKSKGVNVTVFEADGRVGGKLRSVMHNGLIWDEGANT

SEQ ID NO: 66 - protein, 70 aa, Picea sitchensis
MAEHIHTDQNDKRPLKSVAVVGAGISGLAAAYRLKSQGLAVTIFEADGTTGGKIKSFAQNGLIWEKGANT

SEQ ID NO: 67 - protein, 67 aa, Brachypodium distachyon
MAASDDPRAAPARSVAVVGAGVSGLVAAHRLRKSGVRVTVFEADDRAGGKIRTNSDSGFLWDEGANT

SEQ ID NO: 68 - protein, 64 aa, Triticum aestivum
MAASDDPRARSVAVVGAGVSGLVAAYRLRKSGVRVTVFEAEDRAGGKIRTNSDGGFLWDEGANT

SEQ ID NO: 69 - protein, 65 aa, Oryza glaberrima; identical to SEQ ID NO: 25

SEQ ID NO: 70 - protein, 67 aa, Selaginella moellendorffii
MAMAEGETAPVLGSVAVVGAGASGLAAAYRLRAAGVSVTVYEAENSIGGKLKSVSENGFIWEKGPNT

SEQ ID NO: 71 - protein, 67 aa, Selaginella moellendorffii
MAMAEGETVPVLGSVAVVGAGASGLAAAYRLRAAGVSVTVYEAENSIGGKLKSVSENGFIWEKGPNT

SEQ ID NO: 72 - protein, 97 aa, Triticum aestivum
MLTSATAPSSSCSSHAPTRFASARGRRLRPVLAMAASDDPRARSVAVIGAGVSGLVAAYRLRKSGVRVTVFEAEDRAGGKIRTNSDGGFLWDEGANT

SEQ ID NO: 73 - protein, 112 aa, Hordeum vulgare
MLTSATAPPSSSSCSSHAPARFASPSRPRRSASASARGRGRRVRPVLAMAASDDPRARSVAVVGAGVSGLVAAYMLRKSGVRVTVFEAEDRAGGKIRTNSDGGFLWDEGANT

SEQ ID NO: 74 - protein, 70 aa, Ginkgo
MAAPLHPDNNSRRPHKSVAIVGAGISGLAAAYRLKSEGLAVTVFEAEESTGGKIKSISQDGLVWEKGPNT

SEQ ID NO: 75 - protein, 65 aa, Phytophthora capsici
MAARDVVVLGGGISGLTLAYFLRQALPKAAADATRIRVLDASAISGGWVHTAKREGFLFEEGPRG

SEQ ID NO: 76 - protein, 76 aa, Lemna
MEADAGKGSAGGAQILSHDSVRSVAVIGGGISGLAAAYKLKSNGFRAVVFEAEGKAGGKIRSGSQEGLIWDEGANT

SEQ ID NO: 77 - protein, 135 aa, Capsella rubella
MHDAGDSHDPFEIHKHVDVELKSGLDAKTLNKGPLDKRLKIIGPEELKTRFDAELSWLLLITMASAKVADNDTKFEAVSGRRVAVVGGGVSGLAAAYKLKSKGLNVTVFEADGRAGGKLRSVMHNGLIWDEGANT

SEQ ID NO: 78 - protein, 66 aa, Eutrema salsugineum
MAPDAVADHDKKFEALSGKRVAVVGAGVRLKSRGLNVTVFEADGRAGGKLRSVMHKGLIWDEGANT

SEQ ID NO: 79 - protein, 121 aa, Glycine max
MVSVFNEILFPPNQTLLRPSLHSPTSFFTSPTRKFPRSRPNPILRCSIAEESTASPPKTRDSAPVDCVVVGGGVSGLCIAQALATKHANANVVVTEARDRVGGNITTMERDGYLWEEGPNS

SEQ ID NO: 80 - protein, 117 aa, Gossypium raimondii
MTALIDLSLLRSSPSVSPFSIPHHQHPPRFRKPFKLRCSLAEGPTISSSKIDGGESSIADCVIVGGGISGLCIAQALATKHRDVASNVIVTEARDRVGGNITTVERDGYLWEEGPNS

SEQ ID NO: 81 - protein, 115 aa, Brassica napus
MDLSLLRPQPFLSPFSNPFPRSRPYKPLNLRCSVSGGSVVVGSSTIEGGGGGKTVAADCVIVGGGISGLCIAQALVTKHPDAAKSVMVTEAKDRVGGNIITREEQGFLWEEGPNS

SEQ ID NO: 82 - protein, 114 aa, Brassica napus
MDLSLLRPQPFLSPFSNPFPRSRPYKPLNLRCSVSGGSVVGSSTIEGGGGGKTVTADCVIVGGGISGLCIAQALVTKHPDAAKNVMVTEAKDRVGGNIITREEQGFLWEEGPNS

SEQ ID NO: 83 - protein, 62 aa, Bacteria <prokaryote>
MTRHVVILGGGVTGLAAAYRLRRTVPSPDDLAITLVERRSRLGGSIGTERHEGYLIESGVDS

SEQ ID NO: 84 - protein, 113 aa, Setaria italica
MVAAAMATAPSAGVPPLRGTRGPARFRIRGVSVRCAAVAGGAAEAPASAGARVSADCVVVGGGISGLCTAQALATKHGVGDVLVTEARARPGGNITTVERPDEGYLWEEGPNS

SEQ ID NO: 85 - protein, 115 aa, Zea mays
MVAATATATAMATAASPLLNGTRIPARLRHRGLSVRCAAVAGGAAEAPASTGARLSADCVVVGGGISGLCTAQALATRHGVGDVLVTEARARPGGNITTVERPEEGYLWEEGPNS

SEQ ID NO: 86 - protein, 109 aa, Triticum aestivum
MAGATMATATVAAASPLRGRVTGRPHRVRPRCATASSATETPAAPGVRLSAECVIVGAGISGLCTAQALATRYGVSDLLVTEARDRPGGNITTVERPDEGYLWEEGPNS

SEQ ID NO: 87 - protein, 109 aa, Brachypodium distachyon
MATATMATAAATAAPPRRLRVPAPPRGGHARCAVASNATEAPAAPGARLSADCVIVGGGISGLCTAQALATKYGFGDVLVTEARARPGGNITTVERPDEGYLWEEGPNS

SEQ ID NO: 88 - protein, 162 aa, Populus trichocarpa
MTVKQSSVARIKGLINPSSSQITSLQGSGSFACQTESEPAMTSTFTDLSLLRPTIPSLIPSSFSKFTTHRPLKLRCSLTEDSTTFIPFKLNGEAQSSAGHSATADCVIVGGGISGLCIAQALATKHWDVAPNVIVTEARDRVGGNITTLERDGYLWEEGPNS

SEQ ID NO: 89 - protein, 121 aa, Populus trichocarpa
MTTFIDFSLLRPTTPSLIPSSFSKFSTPRPFKLRCSLTEESATITPSKLNGEAQSNGGHSAAADCVIVGGGISGLCIAQALATKHRDVAPNVIVTEARDRVGGNITTLERDGYLWEEGPNS

SEQ ID NO: 90 - protein, 147 aa, Ginkgo
MAMAVEMEAVLTVALQNYPISPLKHFRGTHKKPATISSVFWQCKRNCLAGHAVWKGKTWIGGGVNVVAKEATMAPSGWVENENENDDMYDCVVVGGGISGLSTAQALVSKHSSTVKNVVLTEAKDRVGGNIMTMERDGYLWEEGPNS

SEQ ID NO: 91 - protein, 157 aa, Alopecurus myosuroides
MDFHTIRSPSLYPILVGHGKCKPTNQCSRSRIASSTPHRHLPRAQATEMVGATMAIATVTAALPLRVRVPGRSRRGQARCAVASDATEAPAAPSARLSADCVIVGGGISGLCTAQALATKYGVSDLLVTEARARPGGNITTVERPDEGYLWEEGPNS

SEQ ID NO: 92 - protein, 62 aa, Bacteria <prokaryote>
MKRVVVIGGGISGLSAAYFLKEAAAKKNIDLDYTLIEKSDRLGGNIITEKLDHFIVEGGPDN

SEQ ID NO: 93 - protein, 139 aa, Cyanidioschyzon merolae
MLRWSGSQQVTDRNRAEQHGLVVAFAFPARAPRHSEATHERWTGLAQRERGLCVPLKATKWKRDLWHSRKLQMQEPAQRNREQVQALVVGSGVTGSSFAFLLQHAGISDVICTEARGEVGGNLISRSKDGYLWEEGPNT

SEQ ID NO: 94 - protein, 128 aa, Amaranthus tuberculatus
MSAMALSSSILQCPPHSDISFRFFAHTRTQSPIFFGRPRKLSYIHCSTSSSSTANYQNTITSQGEGDKVLDCVIVGAGISGLCIAQALSTKHIQSNLNFIVTEAKHRVGGNITTMESDGYIWEEGPNS

SEQ ID NO: 95 - protein, 113 aa, Conyza canadensis
MTSLTNFTPLKLTNPNYLTTTTTYNHRKLSNFRFRCSIARDSPTAPSISGDSSSRPLLDCVVVGAGISGLCIAQALSTKHGGDVVVTEARERVGGNISTVERDGYLWEEGPNS

SEQ ID NO: 96 - protein, 121 aa, Lemna
MASSAAISPLHFSPAPPRRRELSHRCRVRCSIAGKPPATAANDSSATSVTGGEPVRRLRADCVIVGAGISGLCTAQALTVRPAAGRSSAPDVLVTEARDRVGGNITTVERDGYLWEEGPNS

SEQ ID NO: 97 - protein, 143 aa, Kochia
MSAMASPSIIPQSFLQRSPTSLQSRSNYSKNHIIISISTPCSHGKNQRRFLRKTTHFRSIHCSTISTSTPTSSSNPGTLGEGGLLDCVIVGGGISGLCIAQALSTKYSSLSTNFIVTEAKDRVGGNITTKEDDGYIWEEGPNS

SEQ ID NO: 98 - protein, 115 aa, Arabidopsis thaliana
MELSLLRPTTQSLLPSFSKPNLRLNVYKPLRLRCSVAGGPTVGSSKIEGGGGTTITTDCVIVGGGISGLCIAQALATKHPDAAPNLIVTEAKDRVGGNIITREENGFLWEEGPNS

SEQ ID NO: 99 - DNA, 639 bp, Artificial Sequence
  Expression cassette
atgactactgctgttactgctgctgtgtctttcccaagtaccaagaccacctctctcagtgctaggtctagttctgtgatctctcctgataagatctcttacaagaaggtgccactctactacagaaacgtgtcagctaccggaaagatgggacctatcagggctcaaatcgcttcttgctctagtatggatgctccttctgatgcattcctctgggtgaaggctctccacattatcgctgttgtttgctggttcgctgcactcttctacctccctagactctacgtgtaccacgctatgtctgaggatgatacctctcatagaaggttcgaggtgatggaaagaaagctctacaggggtatcatgtggccatctatgatcgctactctcatcaccgctcactttctcgtggattggggagatgctactagacactaccatgaggcactctggttctacatcaaggttggacttgttggactcctcgtgatctaccatttcgtgtgcggttactatagaaagaagctcatcggaaacgctcactacaagtctcacaagttttggagatacttcaacgagatgcctaccctcatcctcttcgctgtggttatcctcgttgtggtgaagcctcaattctga

SEQ ID NO: 100 - DNA, 747 bp, Artificial Sequence
  Expression Cassette
atggttattcagtctattacccacctctccccaaacctcgctttgccatctccactttctgtgtccaccaagaactacccagttgctgtgatgggcaacatctctgagagagaggaacctacctctgctaagagggttgcagttgttggagctggtgtttctggacttgctgctgcttacaagctcaagtcccacggactttcagtgacccttttcgaggctgattctagggctggtggaaagcttaagaccgtgaagaaggatggcttcatctgggatgagggtgctaacactatggatgccccatccgatgctttcttgtgggttaaggctctccacattatcgctgtggtttgctggttcgctgcactcttctaccttccaaggctttacgtgtaccacgccatgtctgaggatgacacctctcatagaaggttcgaggtgatggaacgtaagctctacaggggcattatgtggccatccatgattgccacccttattaccgctcacttcctcgtggattggggagatgctactaggcattaccatgaggccctctggttctacattaaggtgggattggtgggactcctcgtgatctaccatttcgtgtgcggctactaccgtaagaagctcattggaaacgcccactacaagagccacaagttttggagatacttcaacgagatgcccaccctgattcttttcgccgtggttattcttgtggtggtgaagccacagttctag

SEQ ID NO: 101 - DNA, 1086 bp, Artificial Sequence
  Expression cassette
atgactactgctgttactgctgctgtgtccttcccatctactaagaccaccagcctttccgccagatcctcctctgttatctccccagacaagatctcctacaagaaggtgcccctctactacagaaacgtgtcagctactggaaagatgggcccaatcagggctcagattgcttcctgctcatccatgaagccagatgctcatcaggtgaagcagttcttgcttaacctccaggataccatctgccagcagttgactgctgttgatggtgctgagttcgttgaggattcttggcaaagggaagctggtggtggtggaaggtctagagttcttagaaacggtggtgttttcgagcaggctggcgtgaacttctctcatgttcatggtgaagctatgccagcttctgctactgctcatagaccagagcttgccggaagatctttcgaggctatgggagtttctcttgtggtgcatccacacaacccatacgttccaacctctcacgcaaacgtgagattcttcattgctgagaagccaggcgctgatccagtttggtggttcggtggtggattcgatcttaccccattctacggcttcgaagaggatgctattcattggcataggaccgctagggatctttgccttccattcggagaggatgtgtaccccaggtacaagaagtggtgcgacgagtacttctacctcaagcacagaaacgagcagaggggaattggaggcctcttcttcgatgatctcaacaccccagatttcgaccgttgcttcgctttcatgcaggctgttggaaagggatacaccgatgcttacctccccatcgttgagagaagaaaggctatggcttacggcgagagagagaggaacttccaactttacagacgtggccgttacgttgagttcaaccttgtttgggatcgtggaacccttttcggacttcaaactggtggtaggaccgagtccatcctcatgtctatgccaccacttgttaggtgggagtacgactaccaacctaaggatggatctccagaggctgctctctccgagttcattaaggttagggattgggtgtga

SEQ ID NO: 102 - DNA, 1194 bp, Artificial Sequence
  Expression Cassette
atggttattcagtctattacccacctctccccaaacctcgctttgccatctccactttctgtgtccaccaagaactacccagttgctgtgatgggcaacatctctgagagagaggaacctacctctgctaagagggttgcagttgttggagctggtgtttctggacttgctgctgcttacaagctcaagtcccacggactttcagtgacccttttcgaggctgattctagggctggtggaaagcttaagaccgtgaagaaggatggcttcatctgggatgagggtgccaacactatgaagccagatgctcatcaggtgaagcagttcttgcttaacctccaggataccatctgccagcagcttactgctgttgatggtgctgagttcgttgaggattcttggcaaagggaagctggtggtggtggaaggtctagagttcttagaaacggtggtgttttcgagcaggctggcgtgaacttctctcatgttcatggtgaagctatgccagcttctgctactgctcatagaccagagcttgccggaagatcattcgaggctatgggagtttctcttgtggtgcatccacacaacccatacgttccaacctctcacgcaaacgtgagattcttcattgctgagaagccaggcgctgatccagtttggtggttcggtggtggattcgatcttaccccattctacggcttcgaagaggatgctattcattggcataggaccgctagggatctttgccttccattcggagaggatgtgtaccccaggtacaagaagtggtgcgacgagtacttctacctcaagcacagaaacgagcagaggggaattggaggcctcttcttcgatgatctcaacaccccagatttcgaccgttgcttcgctttcatgcaggctgttggaaagggatacaccgatgcttacctccccatcgttgagagaagaaaggctatggcttacggcgagcgtgagagaaacttccaactttacagacgtggccgttacgttgagttcaaccttgtttgggataggggaaccctcttcggacttcaaactggtggaagaaccgagtccatcctcatgtctatgccaccacttgttaggtgggagtacgactaccaacctaaggatggatctccagaggctgctctctccgagttcattaaggttagggattgggtgtga

SEQ ID NO: 103 - DNA, 999 bp, Artificial Sequence
  Expression Cassette
atggttattcagtctattacccacctctccccaaacctcgctttgccatctccactttctgtgtccaccaagaactacccagttgccgtgtgctcatccatgaagccagatgctcatcaggtgaagcagttcttgcttaacctccaggataccatctgccagcagcttactgctgttgatggtgctgagttcgttgaggattcttggcaaagggaagctggtggtggtggaaggtctagagttcttagaaacggtggtgttttcgagcaggctggcgtgaacttctctcatgttcatggtgaagctatgccagcttctgctactgctcatagaccagagcttgccggaagatctttcgaggctatgggagtttctcttgtggtgcatccacacaacccatacgttccaacctctcacgcaaacgtgagattcttcattgctgagaagccaggcgctgatccagtttggtggttcggtggtggattcgatcttaccccattctacggcttcgaagaggatgctattcattggcataggaccgctagggatctttgccttccattcggagaggatgtgtaccccaggtacaagaagtggtgcgacgagtacttctacctcaagcacagaaacgagcagaggggaattggaggcctcttcttcgatgatctcaacaccccagatttcgaccgttgcttcgctttcatgcaggctgttggaaagggatacaccgatgcttacctccccatcgttgagagaagaaaggctatggcttacggcgagagagagaggaacttccaactttacagacgtggccgttacgttgagttcaaccttgtttgggataggggaacccttttcggacttcaaactggtggtaggaccgagtccatcctcatgtctatgccaccacttgttaggtgggagtacgactaccaacctaaggatggatctccagaggctgctctctccgagttcattaaggttagggattgggtgtga

SEQ ID NO: 104 - DNA, 732 bp, Artificial Sequence
  Expression Cassette
atgactactgctgttactgctgctgtgtccttcccatctactaagaccaccagcctttccgccagatcctcctctgttatctccccagacaagatctcctacaagaaggtgcccctctactacagaaacgtgtcagctactggaaagatgggcccaatcagggctcagattgcttcctgctcatccatgaagaccctcatcttgttctccaccagggatggacagaccagagagatcgcttcttacctcgcctctgagcttaaagagcttggcattcaggctgacgttgcaaacgttcacaggatcgaagaaccacagtgggagaactacgatagggtggtgattggagcctccattaggtacggacattaccactctgccttccaagagttcgtgaagaagcacgctaccaggctcaactctatgccatccgctttctactccgtgaaccttgttgctaggaagccagagaagaggactccacagactaactcctacgcccgtaagttcctcatgaactctcaatggcgtccagataggtgcgctgttattgctggtgctttgagatacccaaggtacaggtggtacgaccgtttcatgatcaagctcattatgaagatgtccggcggagagactgacaccagaaaagaagttgtgtacaccgactgggagcaggttgcaaacttcgctagagagattgctcacctcaccgataagccaaccctcaagtaa

SEQ ID NO: 105 - DNA, 840 bp, Artificial Sequence
  Expression Cassette
atggttattcagtctattacccacctctccccaaacctcgctttgccatctccactttctgtgtccaccaagaactacccagttgctgtgatgggcaacatctctgagagagaggaacctacctctgctaagagggttgcagttgttggagctggtgtttctggacttgctgctgcttacaagctcaagtcccacggactttcagtgacccttttcgaggctgattctagggctggtggaaagcttaagaccgtgaagaaggatggcttcatctgggatgagggtgccaacactatgaagaccctgatcttgttctccaccagggatggacagaccagagagattgcttcctacctcgcctctgagcttaaagagcttggaatccaggctgacgttgcaaacgttcacaggattgaggaaccacagtgggagaactacgatagggttgtgatcggagcctccattaggtacggacattaccactctgccttccaagagttcgttaagaagcacgctaccaggctcaactccatgccatctgctttctactccgtgaaccttgtggctaggaagccagagaagaggactccacagactaactcctacgcccgtaagttcctcatgaactctcaatggcgtccagataggtgcgctgttattgctggtgctcttagatacccaaggtacaggtggtacgaccgtttcatgatcaagctcatcatgaagatgtccggcggagagactgacaccagaaaagaagttgtgtacaccgactgggagcaggttgcaaacttcgctagggaaattgctcacctcaccgataagccaaccctcaagtaa

SEQ ID NO: 106 - DNA, 645 bp, Artificial Sequence
  Expression Cassette
atggttattcagtctattacccacctctccccaaacctcgctttgccatctccactttctgtgtccaccaagaactacccagttgccgtgtgctcatccatgaagaccctcatcttgttctccaccagggatggacagaccagagagattgcttcctacctcgcctctgagcttaaagagcttggaatccaggctgacgttgcaaacgttcacaggattgaggaaccacagtgggagaactacgatagggttgtgatcggagcctccattaggtacggacattaccactctgccttccaagagttcgtgaagaagcacgctaccaggctcaactctatgccatccgctttctactccgtgaaccttgttgctaggaagccagagaagaggactccacagactaactcctacgcccgtaagttcctcatgaactctcaatggcgtccagataggtgcgctgttattgctggtgctcttagatacccaaggtacaggtggtacgaccgtttcatgatcaagctcattatgaagatgtccggcggagagactgacaccagaaaagaagttgtgtacaccgactgggagcaggttgcaaacttcgctagggaaattgctcacctcaccgataagccaaccctcaagtaa

SEQ ID NO: 107 - DNA, 867 bp, Artificial Sequence
  Expression Cassette
atgcttacttcagctactactccctccagctcctctgcttcttctagagcttctaccaggttcgcctctagctcaagacctagaagaactgcttacgctaggggaagaaggcttaggccagttcttgctatggctgcttctgatgatccaagggctagatctgttgctgttgtgggagctggaatttccggacttgttgctgcttacaggctctccaagtctggtgttagggttaccgttttcgaggctgatgatagggctggcggaaagattaggaccaactccgattctggattcctctgggatgagggtgctaacaccatgaagaccctgatcttgttctccaccagggatggacagaccagagagattgcttcctacctcgcctctgagcttaaagagcttggaatccaggctgacgttgcaaacgttcacaggattgaggaaccacagtgggagaactacgatagggttgtgatcggcgcttccattaggtacggacattaccactctgccttccaagagttcgtgaagaagcacgctaccaggctcaactctatgccatccgctttctactccgtgaaccttgttgctaggaagccagagaagaggactccacagactaactcctacgcccgtaagttcctcatgaactctcaatggcgtccagataggtgcgctgttattgctggtgctcttagatacccaaggtacaggtggtacgaccgtttcatgatcaagctcatcatgaagatgtccggcggagagactgacaccagaaaagaagttgtgtacaccgactgggagcaggttgcaaacttcgctagggaaattgctcacctcaccgataagccaaccctcaagtaa

SEQ ID NO: 108 - DNA, 1590 bp, Artificial Sequence
  Expression Cassette
atgactactgctgttactgctgctgtgtccttcccatctactaagaccaccagcctttccgccagatcctcctctgttatctccccagacaagatctcctacaagaaggtgcccctctactacagaaacgtgtcagctactggaaagatgggcccaatcagggctcagattgcttcctgctcatccatgtctacctccccattcaacccatctgctactgcttcaggtaggccaccaaagaccttcgctgttcttggagctggaattaccggacttaccgctgctcataggcttacccaacttggacataaggtgagggtgttcgagcagtctgatagggtgggaggatctatcaagaccgaagaggttgacggatggctcattgaaggtggaccaaacacccttttgtccggtgagcttgctgtggataagctcattgatgagttgggactcaacggcgagaggattgctgctgatccagctgctaagaaccgttacattgtgagaaggggaagggctcttgctgctccaatgtctcctccatctttcttcgcctcatccctgttctctccagtggctaagttcaagcttctcgctgagcttttcgctaggcgtagggttaggactaccgatgtttctcttgccgagttcgttgagtctcacttcggaagggaattcgtggattacgcccttaacccattcgtgggtggtgtttatgctggcgatccagagaagctttctgccaggcaatctttcccaaagctctgggagattgagcagacccacggatctcttatcaggggacaaattgctgcagccaaggctagaaaggctaggggagagccaagaccaggcatcttctcattcaagcacggacttcatgtgctccctgaagctttggctgctagacttccagctggtgctattacccttggagcttcccttgatgctattgtgccaggcgataagtggaacgttgtgtggcatgatgatgtggctacccacacccagtctttcgattctgttgttgtggctttgccagctccagctcttgctaggcttcaaattggaacccttggtgagaagccactcgctgctcttgctcttattgagcaccctccagtgtccagcttgttccttggattcagaagagagcaggttgcccacccacttgatggattcggagttcttgttccagccgttgagaagagatctgtgctcggagtgctgttctccagctcacttttcccaggtagggctccacttggtcatgttgctcttaccgttatggttggaggaactaggcaaccacagcttgcatctttgcctgctgatcagttgcttgctgctgttaggccagatcttacccagcttcttggagtgtctggtgatccagttttcgtgaggcataacttctggccaagggctatcccacagtacaaccttggacacgagcacttcattgctgctttggcagctggtgagagattccacccaggacttttcatgggaggacaagctagggatggaattgctgtgcctgcttgcattgctgccggtgaaaagcttgctgagagagctggacagtag

SEQ ID NO: 109 - DNA, 1596 bp, Artificial Sequence
  Expression Cassette
atgactactgctgttactgctgctgtgtccttcccatctactaagaccaccagcctttccgccagatcctcctctgttatctccccagacaagatctcctacaagaaggtgcccctctactacagaaacgtgtcagctactggaaagatgggcccaatcagggctcagattgcttcctgttcttccatggcttccgtgggaattatcggagctggaattgctggacttaccgctgcttacgagcttcacagaaggggacttgaggttaccgttttcgaggctaccgataggatcggaggattcattcagtccgagaggatcgatggattcctcgttgaacttggaccacagactcttcagaggacctctggtgatttcgaggaacttctcaggcaagtggatctcgaggatgcttgcattccagctagaccagttgctgccaacagattcattgtgaggggaggacagccaatcccacttcctagatctccaagagagcttctcaggaccccacttctttcaccaagagctaggcttaggcttctcgctgagccattcattcatagggctcataggtccaccgaggaatcagttgctaagttcaccagaagaaggctcggaccagaggttctcgattaccttgttgagcctttcgtggctggaatcttcgctggtgatccagagcaactttctgtgaggtacgccttcccaaagctgttcgagcttgagcaacagtacggatcccttttctggggactcatcagggataggatgaagcagagataccacccagccccaagacgttccatgttctcattcgttgagggactccacatgcttccaagggctcttgctgagagacttccagctcatgctattgtgaggaacgctgaggtgttggctattaggtgggatgagaagaacccatggacccttactttcaggcaacacggaagggcttccaccagattcttcgatattatcgtgtgcgctgtgccactccataggcttgctcaacttaggattcacccaccagtggatagaaggccactttctactgttgagcacccaccaattgctcttgtggctcttggattcaggcgtgagcaagttgcacatccacttgatggattcggaatgcttgtgccagctgttgagagggacttccagattttgggaaccctcttcagctcctcactcttcccagatagggctccagagggacatgttcttttgaccactttcgtgggaggaatgaggcatccagagcttgctttgcttccagaggataggcttgaggctcttgtgttgcaggatcttagaaggctcctcggaatttctggtgctccagttttcaggcatgtttggaggtgggagagatccattccacagtacaggcttggatacgatgctgtgcttgcttgcgttcacgacgttgagatgtctaggtccggacttttcctcgctggcaactacatggaaggcatctctgtgattgatgctctccacaccggacttaaggctgctagggctattattcagcacctcagagaagaggctgctggtggacttgctaagcttgtgcttggagattga

SEQ ID NO: 110 - DNA, 1536 bp, Artificial Sequence
  Expression Cassette
atggttattcagtctattacccacctctccccaaacctcgctttgccatctccactttctgtgtccaccaagaactacccagttgctgtgatgggcaacatctctgagagggaagaacctacctctatggcttccgtgggaattatcggagctggaattgctggacttaccgctgcttacgagcttcacagaaggggacttgaggttaccgttttcgaggctaccgataggatcggaggattcattcagtccgagaggatcgatggattcctcgttgaacttggaccacagactcttcagaggacctctggtgatttcgaggaacttctcaggcaagtggatctcgaggatgcttgcattccagctagacctgttgctgccaacagattcattgtgaggggaggacagccaatcccacttccaagatctccaagagagcttctcaggaccccacttctttcaccaagagctaggcttaggcttctcgctgagccattcattcatagggctcataggtccaccgaggaatcagttgctaagttcaccagaagaaggctcggaccagaggttctcgattaccttgttgagcctttcgtggctggaatcttcgctggtgatccagagcaattgtctgtgaggtacgccttcccaaagctgttcgagcttgagcaacagtacggatcccttttctggggactcatcagggataggatgaagcagagataccacccagccccaagacgttccatgttctcattcgttgagggactccacatgcttccaagggctcttgctgagagacttccagctcatgctattgtgaggaacgctgaggtgttggctattaggtgggatgagaagaacccatggacccttactttcaggcaacacggaagggcttccaccagattcttcgatattatcgtgtgcgctgtgccactccataggcttgctcaacttaggattcacccaccagtggatagaaggccactttctactgttgagcacccacctattgctcttgtggctcttggattcaggcgtgagcaagttgcacatccacttgatggattcggaatgcttgtgccagctgttgagagggatttccagattctcggaaccctcttcagctcctcacttttcccagatagggctccagagggacatgttcttttgaccactttcgtgggaggaatgaggcatccagagcttgctttgcttccagaggataggcttgaggctcttgtgttgcaggatcttagaaggctcctcggaatttctggtgctccagttttcaggcatgtttggaggtgggagagatccattccacagtacaggcttggatacgatgctgtgcttgcttgcgttcacgacgttgagatgtctaggtccggacttttcctcgctggcaactacatggaaggcatctctgtgattgatgctctccacaccggacttaaggctgctagggctattattcagcacctcagagaagaggctgctggtggacttgctaagcttgtgcttggagattga

SEQ ID NO: 111 - DNA, 1611 bp, Artificial Sequence
  Expression Cassette
atgactactgctgttactgctgctgtgtccttcccatctactaagaccaccagcctttccgccagatcctcctctgttatctccccagacaagatctcctacaagaaggtgcccctctactacagaaacgtgtcagctactggaaagatgggcccaatcagggctcagattgcttcctgctcatctatgatggctggctacgattctgtggtgattggaggtggaattgctggacttgctgctgcttacacccttcacaagaggggatacagggttctcgttatcgagtctactaacagggtgggcggagtgattcaaaccattactactccagagggctacatcctcgattgcggaccaaacactgttggaactggtgatgctaggctctggcaagagcttattgatctcggactcagagagaggattaccccagctgctccatgctccaagaggcgtttcattctcattaacggcaccccagttgagatcccaacttctccagtgggccttatcactaccaggcttttgtcttggaggggcaagcttagagttctcgctgagccattcatcaacaggggttctactgatccagatgagtccgtggctgctttcttcaccagaagaattggagctgaggctaccgctcaccttttggatccattcgttgctggtgtgtacgctggtgatccacagagactttctaccgctgctgttttcccatctctttgggaggctgctcaaaggtccggatctattgtgaggggaatgctctctaagccaaagcccaagacccaagtgtctgagccaaagatgaggtctaggaccttcactttcaggggtggtcttgctgaatggccaagggctcttgctcaagctcttggtgctggaaacgtttggaccgagagaagggttgtgaagttgcagccaagagactcatggtgggaggtgaccattgatggtgttaacggaccagagactctcatctcccgttccctcattattgctacccctgctttcaccgccgctgatcttattgagtctgttgatcaaagggctgctggtgctttgaggggtattccatatgctccagttgctgtggtgcacctcggattcagaagggatcagatctcccaagagttgtccggattcggagttcttgctccatcttctgagcagaggcagttccttggaattctctggacctccagcatcttcccacatgttgctccacacgatcatgtgcttaccactaccctttccggtggtgctattagaccagagcttgctgaaaggtctgacgaaacccttatcgaggctgctattagggatcaccaccagcttctcggaattaggggacagccaattttcacccatgttaccagatggcgtaccgctattgctcagtacactttcggtcacagggaaaggattgctaccttggtgcaactcgagcaaaggctcccaactattcagttcgctggatcctacagggatggtgttggagttccaaagacttgggcttctggtgttcaagctggtgagagaattgctgcagctcttgctgctcatggaaccactgctgtttctaccgaaaccgcttctggatga

SEQ ID NO: 112 - protein, 212 aa, Artificial Sequence
  Expression Cassette
MTTAVTAAVSFPSTKTTSLSARSSSVISPDKISYKKVPLYYRNVSATGKMGPIRAQIASCSSMDAPSDAFLWVKALHIIAVVCWFAALFYLPRLYVYHAMSEDDTSHRRFEVMERKLYRGIMWPSMIATLITAHFLVDWGDATRHYHEALWFYIKVGLVGLLVIYHFVCGYYRKKLIGNAHYKSHKFWRYFNEMPTLILFAVVILVVVKPQF

SEQ ID NO: 113 - protein, 248 aa, Artificial Sequence
  Expression Cassette
MVIQSITHLSPNLALPSPLSVSTKNYPVAVMGNISEREEPTSAKRVAVVGAGVSGLAAAYKLKSHGLSVTLFEADSRAGGKLKTVKKDGFIWDEGANTMDAPSDAFLWVKALHIIAVVCWFAALFYLPRLYVYHAMSEDDTSHRRFEVMERKLYRGIMWPSMIATLITAHFLVDWGDATRHYHEALWFYIKVGLVGLLVIYHFVCGYYRKKLIGNAHYKSHKFWRYFNEMPTLILFAVVILVVVKPQF

SEQ ID NO: 114 - protein, 361 aa, Artificial Sequence
  Expression Cassette
MTTAVTAAVSFPSTKTTSLSARSSSVISPDKISYKKVPLYYRNVSATGKMGPIRAQIASCSSMKPDAHQVKQFLLNLQDTICQQLTAVDGAEFVEDSWQREAGGGGRSRVLRNGGVFEQAGVNFSHVHGEAMPASATAHRPELAGRSFEAMGVSLVVHPHNPYVPTSHANVRFFIAEKPGADPVWWFGGGFDLTPFYGFEEDAIHWHRTARDLCLPFGEDVYPRYKKWCDEYFYLKHRNEQRGIGGLFFDDLNTPDFDRCFAFMQAVGKGYTDAYLPIVERRKAMAYGERERNFQLYRRGRYVEFNLVWDRGTLFGLQTGGRTESILMSMPPLVRWEYDYQPKDGSPEAALSEFIKVRDWV

SEQ ID NO: 115 - protein, 397 aa, Artificial Sequence
  Expression Cassette
MVIQSITHLSPNLALPSPLSVSTKNYPVAVMGNISEREEPTSAKRVAVVGAGVSGLAAAYKLKSHGLSVTLFEADSRAGGKLKTVKKDGFIWDEGANTMKPDAHQVKQFLLNLQDTICQQLTAVDGAEFVEDSWQREAGGGGRSRVLRNGGVFEQAGVNFSHVHGEAMPASATAHRPELAGRSFEAMGVSLVVHPHNPYVPTSHANVRFFIAEKPGADPVWWFGGGFDLTPFYGFEEDAIHWHRTARDLCLPFGEDVYPRYKKWCDEYFYLKHRNEQRGIGGLFFDDLNTPDFDRCFAFMQAVGKGYTDAYLPIVERRKAMAYGERERNFQLYRRGRYVEFNLVWDRGTLFGLQTGGRTESILMSMPPLVRWEYDYQPKDGSPEAALSEFIKVRDWV

SEQ ID NO: 116 - protein, 332 aa, Artificial Sequence
  Expression Cassette
MVIQSITHLSPNLALPSPLSVSTKNYPVAVCSSMKPDAHQVKQFLLNLQDTICQQLTAVDGAEFVEDSWQREAGGGGRSRVLRNGGVFEQAGVNFSHVHGEAMPASATAHRPELAGRSFEAMGVSLVVHPHNPYVPTSHANVRFFIAEKPGADPVWWFGGGFDLTPFYGFEEDAIHWHRTARDLCLPFGEDVYPRYKKWCDEYFYLKHRNEQRGIGGLFFDDLNTPDFDRCFAFMQAVGKGYTDAYLPIVERRKAMAYGERERNFQLYRRGRYVEFNLVWDRGTLFGLQTGGRTESILMSMPPLVRWEYDYQPKDGSPEAALSEFIKVRDWV

SEQ ID NO: 117 - protein, 243 aa, Artificial Sequence
  Expression Cassette
MTTAVTAAVSFPSTKTTSLSARSSSVISPDKISYKKVPLYYRNVSATGKMGPIRAQIASCSSMKTLILFSTRDGQTREIASYLASELKELGIQADVANVHRIEEPQWENYDRVVIGASIRYGHYHSAFQEFVKKHATRLNSMPSAFYSVNLVARKPEKRTPQTNSYARKFLMNSQWRPDRCAVIAGALRYPRYRWYDRFMIKLIMKMSGGETDTRKEVVYTDWEQVANFAREIAHLTDKPTLK

SEQ ID NO: 118 - protein, 279 aa, Artificial Sequence
  Expression Cassette
MVIQSITHLSPNLALPSPLSVSTKNYPVAVMGNISEREEPTSAKRVAVVGAGVSGLAAAYKLKSHGLSVTLFEADSRAGGKLKTVKKDGFIWDEGANTMKTLILFSTRDGQTREIASYLASELKELGIQADVANVHRIEEPQWENYDRVVIGASIRYGHYHSAFQEFVKKHATRLNSMPSAFYSVNLVARKPEKRTPQTNSYARKFLMNSQWRPDRCAVIAGALRYPRYRWYDRFMIKLIMKMSGGETDTRKEVVYTDWEQVANFAREIAHLTDKPTLK

SEQ ID NO: 119 - protein, 214 aa, Artificial Sequence
  Expression Cassette
MVIQSITHLSPNLALPSPLSVSTKNYPVAVCSSMKTLILFSTRDGQTREIASYLASELKELGIQADVANVHRIEEPQWENYDRVVIGASIRYGHYHSAFQEFVKKHATRLNSMPSAFYSVNLVARKPEKRTPQTNSYARKFLMNSQWRPDRCAVIAGALRYPRYRWYDRFMIKLIMKMSGGETDTRKEVVYTDWEQVANFAREIAHLTDKPTLK

SEQ ID NO: 120 - protein, 288 aa, Artificial Sequence
  Expression Cassette
MLTSATTPSSSSASSRASTRFASSSRPRRTAYARGRRLRPVLAMAASDDPRARSVAVVGAGISGLVAAYRLSKSGVRVTVFEADDRAGGKIRTNSDSGFLWDEGANTMKTLILFSTRDGQTREIASYLASELKELGIQADVANVHRIEEPQWENYDRVVIGASIRYGHYHSAFQEFVKKHATRLNSMPSAFYSVNLVARKPEKRTPQTNSYARKFLMNSQWRPDRCAVIAGALRYPRYRWYDRFMIKLIMKMSGGETDTRKEVVYTDWEQVANFAREIAHLTDKPTLK

SEQ ID NO: 121 - protein, 529 aa, Artificial Sequence
  Expression Cassette
MTTAVTAAVSFPSTKTTSLSARSSSVISPDKISYKKVPLYYRNVSATGKMGPIRAQIASCSSMSTSPFNPSATASGRPPKTFAVLGAGITGLTAAHRLTQLGHKVRVFEQSDRVGGSIKTEEVDGWLIEGGPNTLLSGELAVDKLIDELGLNGERIAADPAAKNRYIVRRGRALAAPMSPPSFFASSLFSPVAKFKLLAELFARRRVRTTDVSLAEFVESHFGREFVDYALNPFVGGVYAGDPEKLSARQSFPKLWEIEQTHGSLIRGQIAAAKARKARGEPRPGIFSFKHGLHVLPEALAARLPAGAITLGASLDAIVPGDKWNVVWHDDVATHTQSFDSVVVALPAPALARLQIGTLGEKPLAALALIEHPPVSSLFLGFRREQVAHPLDGFGVLVPAVEKRSVLGVLFSSSLFPGRAPLGHVALTVMVGGTRQPQLASLPADQLLAAVRPDLTQLLGVSGDPVFVRHNFWPRAIPQYNLGHEHFIAALAAGERFHPGLFMGGQARDGIAVPACIAAGEKLAERAGQ

SEQ ID NO: 122 - protein, 565 aa, Artificial Sequence
  Expression Cassette
MVIQSITHLSPNLALPSPLSVSTKNYPVAVMGNISEREEPTSAKRVAVVGAGVSGLAAAYKLKSHGLSVTLFEADSRAGGKLKTVKKDGFIWDEGANTMSTSPFNPSATASGRPPKTFAVLGAGITGLTAAHRLTQLGHKVRVFEQSDRVGGSIKTEEVDGWLIEGGPNTLLSGELAVDKLIDELGLNGERIAADPAAKNRYIVRRGRALAAPMSPPSFFASSLFSPVAKFKLLAELFARRRVRTTDVSLAEFVESHFGREFVDYALNPFVGGVYAGDPEKLSARQSFPKLWEIEQTHGSLIRGQIAAAKARKARGEPRPGIFSFKHGLHVLPEALAARLPAGAITLGASLDAIVPGDKWNVVWHDDVATHTQSFDSVVVALPAPALARLQIGTLGEKPLAALALIEHPPVSSLFLGFRREQVAHPLDGFGVLVPAVEKRSVLGVLFSSSLFPGRAPLGHVALTVMVGGTRQPQLASLPADQLLAAVRPDLTQLLGVSGDPVFVRHNFWPRAIPQYNLGHEHFIAALAAGERFHPGLFMGGQARDGIAVPACIAAGEKLAERAGQ

SEQ ID NO: 123 - protein, 531 aa, Artificial Sequence
  Expression Cassette
MTTAVTAAVSFPSTKTTSLSARSSSVISPDKISYKKVPLYYRNVSATGKMGPIRAQIASCSSMASVGIIGAGIAGLTAAYELHRRGLEVTVFEATDRIGGFIQSERIDGFLVELGPQTLQRTSGDFEELLRQVDLEDACIPARPVAANRFIVRGGQPIPLPRSPRELLRTPLLSPRARLRLLAEPFIHRAHRSTEESVAKFTRRRLGPEVLDYLVEPFVAGIFAGDPEQLSVRYAFPKLFELEQQYGSLFWGLIRDRMKQRYHPAPRRSMFSFVEGLHMLPRALAERLPAHAIVRNAEVLAIRWDEKNPWTLTFRQHGRASTRFFDIIVCAVPLHRLAQLRIHPPVDRRPLSTVEHPPIALVALGFRREQVAHPLDGFGMLVPAVERDFQILGTLFSSSLFPDRAPEGHVLLTTFVGGMRHPELALLPEDRLEALVLQDLRRLLGISGAPVFRHVWRWERSIPQYRLGYDAVLACVHDVEMSRSGLFLAGNYMEGISVIDALHTGLKAARAIIQHLREEAAGGLAKLVLGD

SEQ ID NO: 124 - protein, 531 aa, Artificial Sequence
  Expression Cassette
MTTAVTAAVSFPSTKTTSLSARSSSVISPDKISYKKVPLYYRNVSATGKMGPIRAQIASCSSMASVGIIGAGIAGLTAAYELHRRGLEVTVFEATDRIGGFIQSERIDGFLVELGPQTLQRTSGDFEELLRQVDLEDACIPARPVAANRFIVRGGQPIPLPRSPRELLRTPLLSPRARLRLLAEPFIHRAHRSTEESVAKFTRRRLGPEVLDYLVEPFVAGIFAGDPEQLSVRYAFPKLFELEQQYGSLFWGLIRDRMKQRYHPAPRRSMFSFVEGLHMLPRALAERLPAHAIVRNAEVLAIRWDEKNPWTLTFRQHGRASTRFFDIIVCAVPLHRLAQLRIHPPVDRRPLSTVEHPPIALVALGFRREQVAHPLDGFGMLVPAVERDFQILGTLFSSSLFPDRAPEGHVLLTTVVGGMRHPELALLPEDRLEALVLQDLRRLLGISGAPVFRHVWRWERSIPQYRLGYDAVLACVHDVEMSRSGLFLAGNYMEGISVIDALHTGLKAARAIIQHLREEAAGGLAKLVLGD

SEQ ID NO: 125 - protein, 567 aa, Artificial Sequence
  Expression Cassette
MVIQSITHLSPNLALPSPLSVSTKNYPVAVMGNISEREEPTSAKRVAVVGAGVSGLAAAYKLKSHGLSVTLFEADSRAGGKLKTVKKDGFIWDEGANTMASVGIIGAGIAGLTAAYELHRRGLEVTVFEATDRIGGFIQSERIDGFLVELGPQTLQRTSGDFEELLRQVDLEDACIPARPVAANRFIVRGGQPIPLPRSPRELLRTPLLSPRARLRLLAEPFIHRAHRSTEESVAKFTRRRLGPEVLDYLVEPFVAGIFAGDPEQLSVRYAFPKLFELEQQYGSLFWGLIRDRMKQRYHPAPRRSMFSFVEGLHMLPRALAERLPAHAIVRNAEVLAIRWDEKNPWTLTFRQHGRASTRFFDIIVCAVPLHRLAQLRIHPPVDRRPLSTVEHPPIALVALGFRREQVAHPLDGFGMLVPAVERDFQILGTLFSSSLFPDRAPEGHVLLTTFVGGMRHPELALLPEDRLEALVLQDLRRLLGISGAPVFRHVWRWERSIPQYRLGYDAVLACVHDVEMSRSGLFLAGNYMEGISVIDALHTGLKAARAIIQHLREEAAGGLAKLVLGD

SEQ ID NO: 126 - protein, 567 aa, Artificial Sequence
  Expression Cassette
MVIQSITHLSPNLALPSPLSVSTKNYPVAVMGNISEREEPTSAKRVAVVGAGVSGLAAAYKLKSHGLSVTLFEADSRAGGKLKTVKKDGFIWDEGANTMASVGIIGAGIAGLTAAYELHRRGLEVTVFEATDRIGGFIQSERIDGFLVELGPQTLQRTSGDFEELLRQVDLEDACIPARPVAANRFIVRGGQPIPLPRSPRELLRTPLLSPRARLRLLAEPFIHRAHRSTEESVAKFTRRRLGPEVLDYLVEPFVAGIFAGDPEQLSVRYAFPKLFELEQQYGSLFWGLIRDRMKQRYHPAPRRSMFSFVEGLHMLPRALAERLPAHAIVRNAEVLAIRWDEKNPWTLTFRQHGRASTRFFDIIVCAVPLHRLAQLRIHPPVDRRPLSTVEHPPIALVALGFRREQVAHPLDGFGMLVPAVERDFQILGTLFSSSLFPDRAPEGHVLLTTVVGGMRHPELALLPEDRLEALVLQDLRRLLGISGAPVFRHVWRWERSIPQYRLGYDAVLACVHDVEMSRSGLFLAGNYMEGISVIDALHTGLKAARAIIQHLREEAAGGLAKLVLGD

SEQ ID NO: 127 - protein, 511 aa, Artificial Sequence
  Expression Cassette
MVIQSITHLSPNLALPSPLSVSTKNYPVAVMGNISEREEPTSMASVGIIGAGIAGLTAAYELHRRGLEVTVFEATDRIGGFIQSERIDGFLVELGPQTLQRTSGDFEELLRQVDLEDACIPARPVAANRFIVRGGQPIPLPRSPRELLRTPLLSPRARLRLLAEPFIHRAHRSTEESVAKFTRRRLGPEVLDYLVEPFVAGIFAGDPEQLSVRYAFPKLFELEQQYGSLFWGLIRDRMKQRYHPAPRRSMFSFVEGLHMLPRALAERLPAHAIVRNAEVLAIRWDEKNPWTLTFRQHGRASTRFFDIIVCAVPLHRLAQLRIHPPVDRRPLSTVEHPPIALVALGFRREQVAHPLDGFGMLVPAVERDFQILGTLFSSSLFPDRAPEGHVLLTTFVGGMRHPELALLPEDRLEALVLQDLRRLLGISGAPVFRHVWRWERSIPQYRLGYDAVLACVHDVEMSRSGLFLAGNYMEGISVIDALHTGLKAARAIIQHLREEAAGGLAKLVLGD

SEQ ID NO: 128 - protein, 536 aa, Artificial Sequence
  Expression Cassette
MTTAVTAAVSFPSTKTTSLSARSSSVISPDKISYKKVPLYYRNVSATGKMGPIRAQIASCSSMMAGYDSVVIGGGIAGLAAAYTLHKRGYRVLVIESTNRVGGVIQTITTPEGYILDCGPNTVGTGDARLWQELIDLGLRERITPAAPCSKRRFILINGTPVEIPTSPVGLITTRLLSWRGKLRVLAEPFINRGSTDPDESVAAFFTRRIGAEATAHLLDPFVAGVYAGDPQRLSTAAVFPSLWEAAQRSGSIVRGMLSKPKPKTQVSEPKMRSRTFTFRGGLAEWPRALAQALGAGNVWTERRVVKLQPRDSWWEVTIDGVNGPETLISRSLIIATPAFTAADLIESVDQRAAGALRGIPYAPVAVVHLGFRRDQISQELSGFGVLAPSSEQRQFLGILWTSSIFPHVAPHDHVLTTTLSGGAIRPELAERSDETLIEAAIRDHHQLLGIRGQPIFTHVTRWRTAIAQYTFGHRERIATLVQLEQRLPTIQFAGSYRDGVGVPKTWASGVQAGERIAAALAAHGTTAVSTETASG

SEQ ID NO: 129 - protein, 572 aa, Artificial Sequence
  Expression Cassette
MVIQSITHLSPNLALPSPLSVSTKNYPVAVMGNISEREEPTSAKRVAVVGAGVSGLAAAYKLKSHGLSVTLFEADSRAGGKLKTVKKDGFIWDEGANTMMAGYDSVVIGGGIAGLAAAYTLHKRGYRVLVIESTNRVGGVIQTITTPEGYILDCGPNTVGTGDARLWQELIDLGLRERITPAAPCSKRRFILINGTPVEIPTSPVGLITTRLLSWRGKLRVLAEPFINRGSTDPDESVAAFFTRRIGAEATAHLLDPFVAGVYAGDPQRLSTAAVFPSLWEAAQRSGSIVRGMLSKPKPKTQVSEPKMRSRTFTFRGGLAEWPRALAQALGAGNVWTERRVVKLQPRDSWWEVTIDGVNGPETLISRSLIIATPAFTAADLIESVDQRAAGALRGIPYAPVAVVHLGFRRDQISQELSGFGVLAPSSEQRQFLGILWTSSIFPHVAPHDHVLTTTLSGGAIRPELAERSDETLIEAAIRDHHQLLGIRGQPIFTHVTRWRTAIAQYTFGHRERIATLVQLEQRLPTIQFAGSYRDGVGVPKTWASGVQAGERIAAALAAHGTTAVSTETASG

SEQ ID NO: 130 - protein, 543 aa, Artificial Sequence
  Expression Cassette
MLTSATTPSSSSASSRASTRFASSSRPRRTAYARGRRLRPVLAMAASDDPRARSVAVVGAGISGLVAAYRLSKSGVRVTVFEADDRAGGKIRTNSDSGFLWDEGANTMTESEAEVSSLIDDLGLREKQQLPISQNKMYIARDGLPVLLPSNPAALLTSNILSAKSKLQIMLEPFLWRKHNATELSDEHVQESVGEFFERHFGKEFVDYVIDPFVAGTCGGDPQSLSMHHTFPEVWNIEKRFGSVFAGLIQSTLLSKKEKGGENASIKKPRVRGSFSFQGGMQTLVDTMCKQLGEDELKLQCEVLSLSYNQKGIPSLGNWSVSSMSNNTSEDQSYDAVVVTAPIRNVKEMKIMKFGNPFSLDFIPEVTYVPLSVMITAFKKDKVKRPLEGFGVLIPSKEQHNGLKTLGTLFSSMMFPDRAPSDMCLFTTIVGGSRNRKLANASTDELKQIVSSDLQQLLGTEDEPSFVNHLFWSNAFPLYGHNYDSVLRAIDKMEKDLPGFFYAGNHKGGLSVGKAMASGCKAAELVISYLDSHIYVKMDEKTA

SEQ ID NO: 131 - protein, 560 aa, Artificial Sequence
  Expression Cassette
MVIQSITHLSPNLALPSPLSVSTKNYPVAVMGNISEREEPTSAKRVAVVGAGVSGLAAAYKLKSHGLSVTLFEADSRAGGKLKTVKKDGFIWDEGANTATKHPDAAPNLIVTEAKDRVGGNIITREENGFLWEEGPNSFQPSDPMLTMVVDSGLKDDLVLGDPTAPRFVLWNGKLRPVPSKLTDLPFFDLMSIGGKIRAGFGALGIRPSPPGREESVEEFVRRNLGDEVFERLIEPFCSGVYAGDPSKLSMKAAFGKVWKLEQNGGSIIGGTFKAIQERKNAPKAERDPRLPKPQGQTVGSFRKGLRMLPEAISARLGSKVKLSWKLSGITKLESGGYNLTYETPDGLVSVQSKSVVMTVPSHVASGLLRPLSESAANALSKLYYPPVAAVSISYPKEAIRTECLIDGELKGFGQLHPRTQGVETLGTIYSSSLFPNRAPPGRILLLNYIGGSTNTGILSKSEGELVEAVDRDLRKMLIKPNSTDPLKLGVRVWPQAIPQFLVGHFDILDTAKSSLTSSGYEGLFLGGNYVAGVALGRCVEGAYETAIEVNNFMSRYAYK

SEQ ID NO: 132 - protein, 560 aa, Artificial Sequence
  Expression Cassette
MVIQSITHLSPNLALPSPLSVSTKNYPVAVMGNISEREEPTSAKRVAVVGAGVSGLAAAYKLKSHGLSVTLFEADSRAGGKLKTVKKDGFIWDEGANTATKHPDAAPNLIVTEAKDRVGGNIITREENGFLWEEGPNSFQPSDPMLTMVVDSGLKDDLVLGDPTAPRFVLWNGKLRPVPSKLTDLPFFDLMSIGGKIRAGFGALGIRPSPPGREESVEEFVRRNLGDEVFERLIEPFCSGVYAGDPSKLSMKAAFGKVWKLEQNGGSIIGGTFKAIQERKNAPKAERDPRLPKPQGQTVGSFRKGLRMLPEAISARLGSKVKLSWKLLGITKLESGGYNLTYETPDGLVSVQSKSVVMTVPSHVASGLLRPLSESAANALSKLYYPPVAAVSISYPKEAIRTECLIDGELKGFGQLHPRTQGVETLGTIYSSSLFPNRAPPGRILLLNMIGGSTNTGILSKSEGELVEAVDRDLRKMLIKPNSTDPLKLGVRVWPQAIPQFLVGHFDILDTAKSSLTSSGYEGLFLGGNYVAGVALGRCVEGAYETAIEVNNFMSRYAYK

SEQ ID NO: 133 - protein, 538 aa, Artificial Sequence
  Expression Cassette
MVIQSITHLSPNLALPSPLSVSTKNYPVAVMGNISEREEPTSAKRVAVVGAGVSGLAAAYKLKSHGLSVTLFEADSRAGGKLKTVKKDGFIWDEGANTMTESALEASRLIDDLGLEDRLQYPNSQHKRYTVKDGAPALIPSDPIALMKSSLLSTKSKFKLFLEPFLYDKSSTKSSKKVSDEHISESVGSFFERHFGKEVVDYLIDPFVAGTSAGDPESLSIRHAFPGLWNLEKKYGSIIVGAIMSKLTAKGDKKGSAVSGKGRNKRASFSFHGGMQTLVDALHKEVGDGNVKLGAQVLSLACICDGLSASDGWSISVDSKDASNKELTKNHSFDAVIMTAPLSNVQRMKFTKGGAPFVLDFLPKVDYLPLSLMVTAFKKEDVKRPLEGFGVLIPYKEQQKHGLKTLGTLFSSMMFPDRAPNDQHLFTTFVGGSHNRDLAGAPTSILKQLVTSDLGKLLGVEGQPTFVKHIHWRNAFPLYGHDYDSALEAIGKMESDLPGFFYAGNNKDGLAVGNVIASGSKTADLVISYLESGIKQDN

SEQ ID NO: 134 - protein, 538 aa, Artificial Sequence
  Expression Cassette
MVIQSITHLSPNLALPSPLSVSTKNYPVAVMGNISEREEPTSAKRVAVVGAGVSGLAAAYKLKSHGLSVTLFEADSRAGGKLKTVKKDGFIWDEGANTMTESALEASRLIDDLGLEDRLQYPNSQHKRYTVKDGAPALIPSDPIALMKSSLLSTKSKFKLFLEPFLYDKSSTKSSKKVSDEHISESVGSFFERHFGKEVVDYLIDPFVAGTSAGDPESLSIRHAFPGLWNLEKKYGSIIVGAIMSKLTAKGDKKGSAVSGKGRNKRASFSFHGGMQTLVDALHKEVGDGNVKLGAQVLSLACICDGLSASDGWSISVDSKDASNKELTKNHSFDAVIMTAPLSNVQRMKFTKGGAPFVLDFLPKVDYLPLSLMVTAFKKEDVKRPLEGFGVLIPYKEQQKHGLKTLGTLFSSMMFPDRAPNDQHLFTTIVGGSHNRDLAGAPTSILKQLVTSDLGKLLGVEGQPTFVKHIHWRNAFPLYGHDYDSALEAIGKMESDLPGFFYAGNNKDGLAVGNVIASGSKTADLVISYLESGIKQDN

SEQ ID NO: 135 - DNA, 1491 bp, Artificial Sequence
  Expression Cassette
atggttattcagtctattacccacctctccccaaacctcgctttgccatctccactttctgtgtccaccaagaactacccagttgctgtgatgggcaacatctctgagagagaggaacctacctctgctaagagggttgcagttgttggagctggtgtttctggacttgctgctgcttacaagctcaagtcccacggactttcagtgacccttttcgaggctgattctagggctggtggaaagcttaagaccgtgaagaaggatggcttcatctgggatgagggtgccaacactatgctaaaagtgttattgctctttgtgttgctgattgcggggatcgtggttggcccgatgattgccggccatcagggttatgtgctgatccagaccgacaactacaatatcgaaaccagcgtcacgggcctggcgatcatattgattctggcgatggtagtgctgtttgccattgagtggctactgcggcggatcttccgcactggcgcgcacacccgtgggtggtttgtcggacgtaagcgtcgccgtgcacgtaagcagaccgaacaggcgctgctgaaactggcggaaggcgattatcagcaagttgaaaagctgatggcgaaaaatgccgatcacgcggaacaaccggtggtgaactatctactggctgccgaagccgcgcaacaacgtggtgatgaagcacgcgccaaccaacatctggaacgcgcagcggagctggccggcaacgacaccattccggtagaaatcacccgcgtacgtctgcaactggcccgtaatgaaaaccatgctgcacgccacggcgtggataagctgctggaagttacgccacgccatccggaagtattacgtctggcggaacaggcgtatatccgcacaggtgcatggagttcgctgctggatattatcccatcaatggcgaaagcccatgttggtgatgaagaacatcgtgcaatgctggaacaacaggcatggattggcctgatggatcaggcgcgtgccgataacggtagcgaaggtttgcgtaactggtggaaaaaccaaagccggaaaacgcgtcatcaggtagcgttgcaggtggcaatggcggaacatcttattgaatgtgacgatcatgatactgcccagcaaattatcatcgatggcctgaaacgccagtacgacgatcgcctactgctgccgattcctcgactgaaaacaaacaatccggaacagctggaaaaagtgctgcgccagcaaatcaaaaacgtcggcgatcgcccgctgttgtggagcacactgggccagtcactgatgaagcacggagaatggcaggaagcatcgctcgccttccgcgcagcgctgaaacaacgtccggacgcctacgattacgcatggcttgccgacgcgctggacagactgcacaagccggaagaagctgcagctatgcgtcgcgacggtttgatgttaacgttgcagaataacccgccacagtag

SEQ ID NO: 136 - protein, 496 aa, Artificial Sequence
  Expression Cassette
MVIQSITHLSPNLALPSPLSVSTKNYPVAVMGNISEREEPTSAKRVAVVGAGVSGLAAAYKLKSHGLSVTLFEADSRAGGKLKTVKKDGFIWDEGANTMLKVLLLFVLLIAGIVVGPMIAGHQGYVLIQTDNYNIETSVTGLAIILILAMVVLFAIEWLLRRIFRTGAHTRGWFVGRKRRRARKQTEQALLKLAEGDYQQVEKLMAKNADHAEQPVVNYLLAAEAAQQRGDEARANQHLERAAELAGNDTIPVEITRVRLQLARNENHAARHGVDKLLEVTPRHPEVLRLAEQAYIRTGAWSSLLDIIPSMAKAHVGDEEHRAMLEQQAWIGLMDQARADNGSEGLRNWWKNQSRKTRHQVALQVAMAEHLIECDDHDTAQQIIIDGLKRQYDDRLLLPIPRLKTNNPEQLEKVLRQQIKNVGDRPLLWSTLGQSLMKHGEWQEASLAFRAALKQRPDAYDYAWLADALDRLHKPEEAAAMRRDGLMLTLQNNPPQ

SEQ ID NO: 137 - protein, 534 aa, Amaranthus
MVIQSITHLSPNLALPSPLSVSTKNYPVAVMGNISEREEPTSAKRVAVVGAGVSGLAAAYKLKSHGLSVTLFEADSRAGGKLKTVKKDGFIWDEGANTMTESEAEVSSLIDDLGLREKQQLPISQNKRYIARDGLPVLLPSNPAALLTSNILSAKSKLQIMLEPFLWRKHNATELSDEHVQESVGEFFERHFGKEFVDYVIDPFVAGTCGGDPQSLSMHHTFPEVWNIEKRFGSVFAGLIQSTLLSKKEKGGENASIKKPRVRGSFSFQGGMQTLVDTMCKQLGEDELKLQCEVLSLSYNQKGIPSLGNWSVSSMSNNTSEDQSYDAVVVTAPIRNVKEMKIMKFGNPFSLDFIPEVTYVPLSVMITAFKKDKVKRPLEGFGVLIPSKEQHNGLKTLGTLFSSMMFPDRAPSDMCLFTTFVGGSRNRKLANASTDELKQIVSSDLQQLLGTEDEPSFVNHLFWSNAFPLYGHNYDSVLRAIDKMEKDLPGFFYAGNHKGGLSVGKAMASGCKAAELVISYLDSHIYVKMDEKTA

SEQ ID NO: 138 - protein, 461 aa, Salinibacter
MPNVGIIGAGISGLAAAYRLQEHGHSVRVLEASGHTGGVIRSESSEGFLVEHGPNSIRAGAAGLETLIDALDLHEDRVWANDAADTRYVVRDGRPTPLPRSVGSFLTTDLFSTRAKLRLLAEPFIGRAAAEDESVARFTERRLGPEVLNYAVAPFVGGVFAGRPDDLSVQHAFRRLAALEEESGSLLLGAIRRALTSDDGAPPDTPSGLFSFRNGLQTLPNALADTLGDRIRLNAPVHALTHDGTAWRVTVSPPDAPAHTRSFDALVCTVPLHRLAAMEIDTPVDLAPLGEVTYPPLSVLALGYERDAIDHALDGFGMLVPPVEDTLDVLGTIFSSTLFPGRAPEGHVLLTTFVGGARAPHHATSDAAALQARVARDLDSLLGVDASPVFRRLVHWPHAIPQYELGYGTVKDTFDALEAAHPHLAFAGNYRAGVSVGDALTSGLEAADRLLETDERATQPH

SEQ ID NO: 139 - protein, 469 aa, Rhodothermus
MASVGIIGAGIAGLTAAYELHRRGLEVTVFEATDRIGGFIQSERIDGFLVELGPQTLQRTSGDFEELLRQVDLEDACIPARPVAANRFIVRGGQPIPLPRSPRELLRTPLLSPRARLRLLAEPFIHRAHRSTEESVAKFTRRRLGPEVLDYLVEPFVAGIFAGDPEQLSVRYAFPKLFELEQQYGSLFWGLIRDRMKQRYHPAPRRSMFSFVEGLHMLPRALAERLPAHAIVRNAEVLAIRWDEKNPWTLTFRQHGRASTRFFDIIVCAVPLHRLAQLRIHPPVDRRPLSTVEHPPIALVALGFRREQVAHPLDGFGMLVPAVERDFQILGTLFSSSLFPDRAPEGHVLLTTFVGGMRHPELALLPEDRLEALVLQDLRRLLGISGAPVFRHVWRWERSIPQYRLGYDAVLACVHDVEMSRSGLFLAGNYMEGISVIDALHTGLKAARAIIQHLREEAAGGLAKLVLGD

SEQ ID NO: 140 - protein, 461 aa, Salinibacter
MPNVGIIGAGISGLAAAYRLQEHGHSVRLLEASGHTGGVIRSESSEGFLVEHGPNSIRAGAAGLETLIDALDLHEDRVWANDAADTRYVVRDGRPTPLPRSVGSFLTTDLFSTRAKLRLLAEPFIGRAAAEEESVARFTERRLGPEVLNYAVAPFVGGVFAGRPDDLSVQHAFRRLAALEEESGSLLLGAIRRALTSDDGAPPDTPSGLFSFRNGLQTLPNALADTLGDRIRLNAPVHALAHDGTAWRVTVSPPDAPAHTRSFDALVCTVPLHRLAAMEIDTPVDLAPLGEVTYPPLSVLALGYGRDAIDHALDGFGMLVPPVEDTLDVLGTIFSSTLFPGRAPEGHVLLTTFVGGARAPHHATSDAAALQARVARDLDSLLGVDASPVFRRLVHWPHAIPQYELGYGTVKDTFDALEAAHPHLAFAGNYRAGVSVGDALTSGLEAADRLLETDERAAQPH

SEQ ID NO: 141 - protein, 469 aa, Rhodothermus
MASVGIIGAGIAGLAAAYELHRRGLEVTVFEATDRIGGFIQSERIDGFLVEHGPQTLQRTSGDFEELLRQVDLEDACITARPIAANRFIVRGGRPIPLPRSPRELLRTPLLSPRARLRLLAEPFIHRAHRSTEESVAKFARRRLGPEVLDYLVEPFVAGIFAGDPEQLSVRYAFPKLFELEQQYGSLFWGLIRDRMKQRYHPAPRRSMFSFVEGLHMLPRALADRLPAHAIVRNAEVLAIRWDEKNPWTLTFRQHGRASTRFFDIIVCAVPLHRLAQLRIHPPVDRRPLSTVEHPPIALVALGFRREQVAHPLDGFGMLVPAVERDFQILGTLFSSSLFPDRAPEGHVLLTTFVGGMRHPELALLPEDRLEALVLQDLRRLLGISGAPVFRHVWRWERSIPQYRLGYDAVLACVHDVEMSRSGLFLAGNYMEGISVIDALHTGLKAARAIIQHLREEAAGGLAKLVLGD

SEQ ID NO: 142 - protein, 472 aa, Halothiobacillus
MNTHSNASEPINCPYLVIGGGISGLATAYHLSRMGKTVTVLEATSRVGGAVGSIEEDGWLRELGPNSLVQTPEMAALMSALDLVSEIIEANTVAKKRFVAKNGHPVALPGSPLELLTSPLFSMGDLWHLAREAWIKPVNKEETIAEFVRRRLGQGFLDWAVDPFVSGVYAGDPNRLSVQAAIPKIYAFEQESGSLIRGGIAKMKAAKANPAPVTLPAKGKLFSFKRGLQTLTDALATAITSSGRGNIQLDSAITNIQRLPEGGWSVKTVQGKTFHTRQLILSTPAHVSAQLLGEVDGPLAETLAAIEYPPVTSVVMGFDRSEVAHPLDGFGLLLPSKEKKRTLGVLFSSTLFPDRTPAGKVLLSAFIGGRKHPEAAQGDDQELLDRVLGDLSPLLGIKGKPEFLRVKRWQQAIPQYEIGYLELQEKISQRLTALPGLSLNGNWRGGIAVGDCLNNGNKLAERLIENTRTEES

SEQ ID NO: 143 - protein, 441 aa, Corallium
MPDTCIIGAGITGLATAWQYQRKGKDCVVLESGPQVGGAIQSILQDGYLAEEGPNSIQLNSLEIEDFLTSIPGLEAQIIEANPAAQKRYIVRKGRLRAVPMNPLQAITTQLWSIAGKLRVLREPFIKAAPPEPDQSVADFVTRRLGKELYDYAINPLVGGIYAGKPEMLSLRYGFPKLYALEQEHGGLIRGALAKMKAAKANKGPKAKKYILSFKDGLQTLPQSIANNLNEPVQTGVSIESIRQIEDMWAVRWNGQVKAFKELIVTVPAHKLPGLPFEEPIRLPAIDYPPVSVISLGYPLSAIKQPLDGFGALVPEREDRNILGVLFPSAVFDGRAPEGHGLLTVFVGGSRSPECSSPDTDQLLKTIQPDLETLLGIQDEPSFVHHKHWPMAIPQYTLGYEKVLEAITRIEQQYIGLKLAGNYRTGISLSYCLESAIASTN

SEQ ID NO: 144 - protein, 463 aa, Magnetococcus
MTKNPILIIGGGISGLSTAWFLHKKGEKVILLESRDRVGGNIRTSRNPEGYLIEHGPNSTLQKPGDEEDALGRIITDMALESELQEANPLAARRFVMKGGQLHVLPTSPPGFIKTPLFSLSAKLRLCLEPFIGKSEQEESIAQFVIRRLGQEFLDYAIEPFVSGVYAGDPKQLSVRAAVAKIYALEAKYGSLIKGAIALGKIRKAAGMPRGRMISFETGMETLPATIANRLPHQSIHTNAQVTALCQHGAAWQVSWQQGGQHGGEPHSIIASQVVLATPASVSAQLLRPLSPQAADLLESIRYAPVDSVALGYAKQDINHSLDGFGFLIPRKEQVTTLGGLFSTTLFPGRAPQDKALLTCFIGGMTNPSITQWSEEKVVTQVDQDMMAALGIQHGAEYVHLTRYTHAIAQYEQGHLQRVGDIDRALAGYKGLHLRANWRDGVSVSDCVLNGEKSAQKILAGVS

SEQ ID NO: 145 - protein, 467 aa, Opitutus
MSTSPFNPSATASGRPPKTFAVLGAGITGLTAAHRLTQLGHKVRVFEQSDRVGGSIKTEEVDGWLIEGGPNTLLSGELAVDKLIDELGLNGERIAADPAAKNRYIVRRGRALAAPMSPPSFFASSLFSPVAKFKLLAELFARRRVRTTDVSLAEFVESHFGREFVDYALNPFVGGVYAGDPEKLSARQSFPKLWEIEQTHGSLIRGQIAAAKARKARGEPRPGIFSFKHGLHVLPEALAARLPAGAITLGASLDAIVPGDKWNVVWHDDVATHTQSFDSVVVALPAPALARLQIGTLGEKPLAALALIEHPPVSSLFLGFRREQVAHPLDGFGVLVPAVEKRSVLGVLFSSSLFPGRAPLGHVALTVMVGGTRQPQLASLPADQLLAAVRPDLTQLLGVSGDPVFVRHNFWPRAIPQYNLGHEHFIAALAAGERFHPGLFMGGQARDGIAVPACIAAGEKLAERAGQ

SEQ ID NO: 146 - protein, 451 aa, Melioribacter
MSKKIVVLGAGISGLSTAYWLVKKGYDVTILETKNEPGGSMISRRLDNFLIDYGPNSGLETTPLIRKLVEEVNLSDKMIYANAAASKRYILKNGELIPLPMSPGSFIRTKLFSSGAKFRLMAEPFVSKSDDGYYQSIAEFVRRRLGNEFLDYAIDPFVSGVFAGDPEKLSVKSAFPKLYRLEEVYGGLIKGMIKGARERKQRNEESKQSAKMFSFLEGMQSLPNAIADKLKDNIVFSAKVLNVTGANDKQWKVTYELNGNRESITADTVISTLPAYIAAGVFGELDQKLAERLNSIYYPPVMVLYLGYNKKDIKRKLDGFGFLIPSKEKKHFLGAIWSSSIFPGRSPEDMAAFTLFVGGARSPQLFEMEKSDLIKKVLSEFHQIMNIKGEPVLIENKLWQKAIPQYNLGYIEHEKYFEVFEENHRGIYLRGNYRGGISVGDCIKNSELEIK

SEQ ID NO: 147 - protein, 501 aa, Physcomitrella
VAVVGAGVSGLAAAHRLRSAGVAVTVFEAQNAVGGKIQSFSNDGLIWEQGPNTMVETEPEVSSLIDELGLREKQQWPVMQNKRYVVRDGKAVQLPSNPLGLITTKLLSAQAKCQILLEPFLWKRKEVPLKEAANGRENVGNFITRHFGREVVDYLVDPFIAGTSGSDPDSVSIRHTFPDLFAIEERYGSLLIGGVKSSFKKKSGSKKESFKVQSDSAKVTPAQKRPRGSFSFVGGMQTLAHALSERLDEESLELNSSVLNLASDQQGNPSRNNWTVTYKKENSQQKEKHFDAVILTTPLHNLQELGIEKNGIPYALDFIPEIVYQPMSVIVTAFKESDVKNSLKGFGVLVPRMEKKNGFFTLGTMFSSSMFPDRAPPGQVVFTTFVGGSRNRALASAPFEEVKAVALEDLRKIVGVQGPPVAVKHIFWKQAFPQYSLDYNEFLSSLEKMESDLPGLFYAGNHRGGLSVGKSVASGCKAAEHVLSMLEGTGGRKIFTMASTK

SEQ ID NO: 148 - protein, 511 aa, Ricinus <angiosperm>
MSSVIKEDRNPSHVKRVAVVGAGVSGLAAAYKLKSHGLKVTVFEAEERAGGKLRSVNHDGLIWDEGANTMTESEMEVKSLIGNLGIREKQQFPISQNKRYIVRNGKPILIPTNPIALITSNILSAQSKFQIILEPFLWKKRESSETHNAYTEESVGEFFQRHFGKEVVDYLIDPFVAGTSAGDPESLSVCHSFPELWNLEKRFGSIIAGVVQAKLSTKRGKSQETKGSSVKKKQQRGSFSFFGGMQTLTDTLCKALAKDELRLESKVFSLSYNPDSKSAVENWSLSYAFKGAKHLQNSSYDAIVMTAPLCNVKEMKITKNRNIFSLNFLPEVSYMPLSVVITTFKKDNVKSPLEGFGVLVPSKEQQNGLKTLGTLFSSMMFPDRAPNDLYLYTTFVGGSRNKELAKASTDDLKQIVTSDLRQLLGAEGEPTFVNHFYWSKAFPLYGRNYDAVLEAIDTMEKDLPGFFYAGNHKGGLSVGKAIASGCKAADLVISYLESSSDDKMLKEGPSN

SEQ ID NO: 149 - protein, 476 aa, Chromohalobacter
MQHEEQLDATDQAVGEARRDVVVVGGGASGLAAARAAARRGLAVSVLERGSHAGGNLRTHRDGAWQVEVGPNTLVMKPPLHTLLDELGLLDEAQPANPDARRRYIAFHGRPVALPTHVLKAPANPLIGLRGSWSVLREPFRAGPPRDEESLADFVVRRLGRHVLDHLVDPFVSGVYAGDPARLSAQAAMPRLVALEREYGSLVRGGLRRLRQSRREPPALPREWRGQLVSFPAGLQRLAERLAEDIADQPGASVQCGCEVVAVGREADGWQVETAAGQRIRTRELVLAVPAPTAAALLAPLDAALAAPLEEIAYPPVNAVSVGFRRADVDHPLDGFGMLIPGVERRRTLGALFSSTLFPGRAPSDHVLLTAFLGGRRQPEAAAGDDAEQVAQVVADLGDLLGIHAEPVWQCVSRWPQAIPQYERGHLARIAALDAALEAHPGLSLLGNWRDGIAVGDCLENGRRLGERLAETPDRR

SEQ ID NO: 150 - protein, 462 aa, Leptospirillum
MAGFDCDTLVVGGGVSGLAAALTLKNRGVDVRLLESRGYLGGAIRTVREDGYLLEFGPNSLMVRPEDAIDTVLGDPELRARIVPASGLSKNRYVVKAGHLYPVPLSPWAFFRTPLLSWRGRRDILSEWKVPPRTGGPEETLSHFVRRRLGEEALDYFVDPFVKGVYASHPDLLSVEAAFPLLVRLEREHGGLLRGALKTFLKRRKRPSGSSPRGIFSFAGGMTDLVEAMGKRLGEDVGTNVDVIKYTRLEEGFRVALMYDETEYYMTSRRLILATSAPQAAELLEGDPDGPSSELKSIPYAPVTIAYAGFLREQVTHPLDGFGLLCPTVENRKVLGVIFSSSLFPGRAPEGKVLLTVFVGGMTGQKLAQAFDEDLERIVLKELTELLGVKGAPSFFRIHRWEKAIPQLILGHRETVRTIRKKLPSGLRLAGNYLDGISIARAFASGVRAAEELLSEDGGTPG

SEQ ID NO: 151 - protein, 514 aa, Selaginella
MAMAEGETVPVLGSVAVVGAGASGLAAAYRLRAAGVSVTVYEAENSIGGKLKSVSENGFIWEKGPNTMTENDPSISRMFDDLHLRDKQQFPVEQKKRYIVRNASPTMLPSNPLGFITTGLFSAQAKLKLLTEPFSWKRTKAESNEDESVGAFMERHFGDEIVDYAVDPFVAGTSGSDPSSISIRHSFPELWSLEKNYGSLFVGAIKSGFSKKKKQKLRPVEFEDEDSDFPARTRPRRGGSFSFVGGMQTLANELVSRIGKEKFKLNTFVTGLACNQQGNPSRQSWTVTGLETSGKRSKRSDKTFDAVIMTAPVDDVRTMKVVKDGKPYALDYLPTVIYEPMSVLITMFNKDSVKRALPGFGVLVPSKEQQANGFQTLGTLFSSFMFPDRAPEDQLLFTTFIGGSRNTLLASRSKEELLDVTLKDLSRLIGVEGQPTAMRHVYWEKAFPRYSIGYDNVLNSIQKLESDLPGLFYAGNHRGGLAVGKTIVSGLDAAEQVLQYLQGSGGKKVFTMAS

SEQ ID NO: 152 - protein, 520 aa, Selaginella
MAMAEGETAPVLGSVAVVGAGASGLAAAYRLRAAGVSVTVYEAENSIGGKLKSVSENGFIWEKGPNTMTENDPSISRMFDDLHLRDKQQFPVEQKKRYIVRNASPTMLPSNPLGFITTGLFSAQAKLKLLTEPFSWKRTKAESNEDESVGAFMERHFGDEIVDYAVDPFVAGTSGSDPSSISIRHSFPELWSLEKNYGSLFVGAIKSGFSKKKKQKLRPVEFEDEDSDFPARTRPRRGGSFSFVGGMQTLANELVSRIGKEKFKLNTFVTGLACNQQGNPSRQSWTVTGLETSGKRSKRSDKTFDAVIMTAPVDDVRAMKVVKDGKPYALDYLPTVIYEPMSVLITMFNKDSVKRALPGFGVLVPSKEQQANGFQTLGTLFSSFMFPDRAPEDQLLFTTFIGGSRNTLLASRSKEELLDITLKDLSRLIGVEGQPTAIRHVYWEKAFPRYSIGYDNVLHSIQKLESDLPGLFYAGNHRGGLAVGKTIVSGLDAAEQVLQYLQGSGGKKVFTMASLEQPVS

SEQ ID NO: 153 - protein, 508 aa, Arabidopsis
MASGAVADHQIEAVSGKRVAVVGAGVSGLAAAYKLKSRGLNVTVFEADGRVGGKLRSVMQNGLIWDEGANTMTEAEPEVGSLLDDLGLREKQQFPISQKKRYIVRNGVPVMLPTNPIELVTSSVLSTQSKFQILLEPFLWKKKSSKVSDASAEESVSEFFQRHFGQEVVDYLIDPFVGGTSAADPDSLSMKHSFPDLWNVEKSFGSIIVGAIRTKFAAKGGKSRDTKSSPGTKKGSRGSFSFKGGMQILPDTLCKSLSHDEINLDSKVLSLSYNSGSRQENWSLSCVSHNETQRQNPHYDAVIMTAPLCNVKEMKVMKGGQPFQLNFLPEINYMPLSVLITTFTKEKVKRPLEGFGVLIPSKEQKHGFKTLGTLFSSMMFPDRSPSDVHLYTTFIGGSRNQELAKASTDELKQVVTSDLQRLLGVEGEPVSVNHYYWRKAFPLYDSSYDSVMEAIDKMENDLPGFFYAGNHRGGLSVGKSIASGCKAADLVISYLESCSNDKKPNDSL

SEQ ID NO: 154 - protein, 454 aa, Acidithiobacillus
MSSETVIVVGAGLTGLSATWYLHQRGIPALLLEAEAEVGGNLRSRSEDGFLRDLGPNSLMIKGDLLPDLIRQLQLEDRVVEANPLARRRFVLNRRGHPVALGPDVLFSSSLLSLSARLRLLSEPWRPRRPQSQNDESIADFVRRRLGPEALTWMVDPFVSGVFAGDPEKLSVTAALPRLAAMEAESGSLLRAALRRRRAGKKEGSSRLVSFRGGLQELPRALAARLPPDRLALSRPLTHLQRRGELWHLQTPAGDLECRRLVLALPAAESARLLRAEAPELAAELEAIVYPAVATVALGFPREAVDHRLDGFGLLIPRRLGIETLGVLFSSTLFPERAPPGMVLLTAFLGGAQQDISGRSPAELEAQALADLRPILGIRGDPAYHRCALWPRAIPQYALGHRQRVERIHELRRQLAGLELLGNWQGGVALGDCVVQADAFQRTFAQVDTATGPS

SEQ ID NO: 155 - protein, 512 aa, Arabidopsis
MESGAVGDHDTKFESISGKRVAVVGAGVSGLAAAYKLKSRGLNVTVFEADERAGGKLTSVMQNGLIWDQGANTMTEAEPEVGSLLDDLGLRDKQQFPISQKKRYIVRNGLPMMLPTNPIELVTSSVLSTQAKIQILLEPFLWKKNDSSSKVSDASAEESVSGFFQRHFGQEVVDYLIDPFVGGTSAADPDSLSMKHSFPDLWNVEKSFGSIIVGAIRTKLAAKGGKSGEAKSSPGTKRGSRRSFSFKGGMQILPDMLCKSLSHDEINLDSKVLSLSYNSGSRQENWSLSCVSHNETQRQNLHYDAVVMTAPLCNVKEMKVTKGGQPFLLNFLPEINYMPLSVLITTFTKEKVKRPLEGFGVLIPSKEKKHGFKTLGTLFSSMMFPDRCPSDLHLYTTFIGGSRNQELAKASTDELKQVVTSDLQRLLGVEGEPVSVNHYYWRKAFPLYDSSYGSVMEAIDKMEKDLPGFFYAGNHRGGLSIGKSIASGCKAADLVISYLESCSNDKKPDESL

SEQ ID NO: 156 - protein, 502 aa, Glycine
MASSATDDNPRSVKRVAVVGAGVSGLAAAYKLKSHGLDVTVFEAEGRAGGRLRSVSQDGLIWDEGANTMTESEIEVKGLIDALGLQEKQQFPISQHKRYIVKNGAPLLVPTNPAALLKSKLLSAQSKIHLIFEPFMWKRSDPSNVCDENSVESVGRFFERHFGKEVVDYLIDPFVGGTSAADPESLSMRHSFPELWNLEKRFGSIIAGALQSKLFAKREKTGENRTALRKNKHKRGSFSFQGGMQTLTDTLCKELGKDDLKLNEKVLTLAYGHDGSSSSQNWSITSASNQSTQDVDAVIMTAPLYNVKDIKITKRGTPFPLNFLPEVSYVPISVMITTFKKENVKRPLEGFGVLVPSKEQKNGLKTLGTLFSSMMFPDRAPSDLYLYTTFIGGTQNRELAQASTDELRKIVTSDLRKLLGAEGEPTFVNHFYWSKGFPLYGRNYGSVLQAIDKIEKDLPGFFFAGNYKGGLSVGKAIASGCKAADLVISYLNSASDNTVPDK

SEQ ID NO: 157 - protein, 474 aa, Chloroflexus
MMAGYDSVVIGGGIAGLAAAYTLHKRGYRVLVIESTNRVGGVIQTITTPEGYILDCGPNTVGTGDARLWQELIDLGLRERITPAAPCSKRRFILINGTPVEIPTSPVGLITTRLLSWRGKLRVLAEPFINRGSTDPDESVAAFFTRRIGAEATAHLLDPFVAGVYAGDPQRLSTAAVFPSLWEAAQRSGSIVRGMLSKPKPKTQVSEPKMRSRTFTFRGGLAEWPRALAQALGAGNVWTERRVVKLQPRDSWWEVTIDGVNGPETLISRSLIIATPAFTAADLIESVDQRAAGALRGIPYAPVAVVHLGFRRDQISQELSGFGVLAPSSEQRQFLGILWTSSIFPHVAPHDHVLTTTLSGGAIRPELAERSDETLIEAAIRDHHQLLGIRGQPIFTHVTRWRTAIAQYTFGHRERIATLVQLEQRLPTIQFAGSYRDGVGVPKTWASGVQAGERIAAALAAHGTTAVSTETASG

SEQ ID NO: 158 - protein, 499 aa, Medicago
MASSAKDDNPRSVKRVAVVGAGVSGLAAAYKLKSHGLDVTVFEAEGRAGGRLRTVSRDGLVWDEGANTMTENEIEVKGLIDALGLHEKQQYPLSQHKRYIVKNGTPVLVPANPAALLKSKLLSAQSKIQVIFEPFMWKRSDSSAVRDENSEESVSRFFERHFGKEVVDYLIDPFVGGTSAAGPESLSIRHSFPELWNLEKRFGSIIAGALQSSVFGKKDKAGETKDVPRKNKHQRGSFSFQGGMQTLTDTLCKELGKDDIKLNAKVLTLAYSHDGSSPSQNWSITCTSNRKAQDVDAVIMTAPLGNVRDIQIKKKGNPFPLNFLPEVTYLPLSVLITTFKKENVKRPLEGFGVLVPSKEQQNGFKTLGTLFSSMMFPDRAPSDMHLYTTFIGGTRNRELAQASTDELTKIVTSDLRKLLGAEGEPAFVNHFFWSKGFPLYGHNYGSVLEAIDKMEKDLPGFFYAGNHRGGLSVGRAIASGCKAADLVISYLNNASDNSV

SEQ ID NO: 159 - protein, 475 aa, Chloroflexus
MMMANYDSVVIGGGIGGLAAAYTLYKRGYRVLVIEAANRVGGVIHSITTPEGFTLDCGPNTIGTNDVRLWQELIDLGLRDRIRPAARCGRRRYILINGTPIEIPSSPVGLITTRLLSWRGKLRVLGEPFVNIGTPTGEESVAAFFSRRIGHEAVAHLLDPFVAGVYAGDPNQLSAAAVFPSLWEAVQRGGSIVRGMLRRPKQKTLISEPKMRSRTFSFQGGLADWPRAIARALGTGNVWTGRRAVGLRDLGTYWEVTVDGTGRLETITTRSVIIATPAYVAAELVEALDPAAASALRSIPYAPVSVVHLGFRRDQLSHELNGFGVLAPSSERRQFLGILWASSLFPHVAPPDRVLTITLSGGAIRPEVAEQSEEALIESAIRDNQEVLGIRGQPLLTHVTRWHHAIAQYTLGHRERIATLERLEQRRPTLQLTGSYRGGIGIPKTWASGVGAGERIAAALDAQGTTADTLEQARG

SEQ ID NO: 160 - protein, 508 aa, Vitis
MAEKSDAQSHYNGSGKRVAVVGAGVSGLAAAYKLKLHGVNITLYEAEERAGGKLRSVSQHGLVWDEGANTMTESEIEVGSLLDNLRLREKQQFPISQNKRYIVRNGMPVLLPSNPIALIKSNILSAKSKFQIILEPFLWKKSDLSKVSDDHMKESVGGFFQRHFGKEVVDYLIDPFVAGTSGGDPESLSMHHTFPELWNLEKRFGSIIAGAVLSKLSAKREKRGETKGSSEKKKRQRGSFSFQGGMQTLTDTLCKELGKDKLRLKSKVLSLSYSHGEKSALENWSVAYASNPGKQSKDLSFDAVIMTAPLCNVREMKIMKKGNPFLLDFLPEVSYLPLSVIITTFKKENVKRPLEGFGVLVPSKEQQNGLKTLGTLFSSMMFPDRAPNDLYLYTTFIGGSRNRELAKASTDELKQIVTSDLRQLLGAEGEPTFVNHFYWSKAFPLFGHNYDSVLEAIDKMEKDLPGFFYAGNHKGGLSVGKAIASGCKAADLVISYLNSSSDGKMFKE

SEQ ID NO: 161 - protein, 544 aa, Zea
MLALTASASSASSHPYRHASAHTRRPRLRAVLAMAGSDDPRAAPARSVAVVGAGVSGLAAAYRLRQSGVNVTVFEAADRAGGKIRTNSEGGFVWDEGANTMTEGEWEASRLIDDLGLQDKQQYPNSQHKRYIVKDGAPALIPSDPISLMKSSVLSTKSKIALFFEPFLYKKANTRNSGKVSEEHLSESVGSFCERHFGREVVDYFVDPFVAGTSAGDPESLSIRHAFPALWNLERKYGSVIVGAILSKLAAKGDPVKTRHDSSGKRRNRRVSFSFHGGMQSLINALHNEVGDDNVKLGTEVLSLACTFDGVPALGRWSISVDSKDSGDKDLASNQTFDAVIMTAPLSNVRRMKFTKGGAPVVLDFLPKMDYLPLSLMVTAFKKDDVKKPLEGFGVLIPYKEQQKHGLKTLGTLFSSMMFPDRAPDDQYLYTTFVGGSHNRDLAGAPTSILKQLVTSDLKKLLGVEGQPTFVKHVYWGNAFPLYGHDYSSVLEAIEKMEKNLPGFFYAGNSKDGLAVGSVIASGSKAADLAISYLESHTKHNNSH

SEQ ID NO: 162 - protein, 478 aa, Arabidopsis
MASGAVADHQIEAVSGKRVAVVGAGVSGLAAAYKLKSRGLNVTVFEADGRVGGKLRSVMQNGLIWDEGANTMTEAEPEVGSLLDDLGLREKQQFPISQKKRYIVRNGVPVMKKSSKVSDASAEESVSEFFQRHFGQEVVDYLIDPFVGGTSAADPDSLSMKHSFPDLWNVEKSFGSIIVGAIRTKFAAKGGKSRDTKSSPGTKKGSRGSFSFKGGMQILPDTLCKSLSHDEINLDSKVLSLSYNSGSRQENWSLSCVSHNETQRQNPHYDAVIMTAPLCNVKEMKVMKGGQPFQLNFLPEINYMPLSVLITTFTKEKVKRPLEGFGVLIPSKEQKHGFKTLGTLFSSMMFPDRSPSDVHLYTTFIGGSRNQELAKASTDELKQVVTSDLQRLLGVEGEPVSVNHYYWRKAFPLYDSSYDSVMEAIDKMENDLPGFFYAGNHRGGLSVGKSIASGCKAADLVISYLESCSNDKKPNDSL

SEQ ID NO: 163 - protein, 441 aa, Hydrogenobacter
MIDVAVVGAGISGLSIAYHLKKAGLEVKVFEKEDAVGGNIQTAYIDGYVCELGPQTILADSKVEEFLKDAGIKPIYANPSSKKRYIYRKGKLVALPLSPVEFLLSPFLSLGGKLRVLKEPFVPRSPKQEESIAEFVRRRFGREFLDYVVAPFVSGVYAGDPEELSVKYAVRKVYELEQKYGSVIKGAIKLKALGPSGKLISFEGGNATLIRKLSESLEVHKENVVLRIRRKDDIFILDTKEGKVTAKAVVVSTPATSTGYLLRDLSWSISEEFDKIYYAPVLVVHVAVKFGVLPEGFGFLVPKKENKRILGVIFSSNLFEGRSPEGKSLITVYIGGATDPEIIEYEDEAIVSVLERELRETVDIRDWDLLKITRWKKGIPQYTVGYGRYLELANSIEMEQPGLFLSGNYLYGVSVADCIRVSHHIAKRVIDFLEVKGRTVV

SEQ ID NO: 164 - protein, 458 aa, Thermovibrio
MRVCVIGGGVSGLSTAFYLKRGGAQVKLLERENYPGGKARTYYEKGYIVESGPNGFLDGKPDTLELVKLLGAEKLLYRSSDKARKRFIYKNGRLVRLPENPIAFLSSYLLSWKGKVRVLGELLVPPSEKEDETLAEFVRRRLGKEALDYLLDPMVAGIFAGDPERMSLKAAFPTIYRLEREYGGLIRGLIAKAKEAKKKGAKSSGPAGPGGVLTSFVKGMSQFTQLLAQELGESFTPEAQVKTLEKKKDKWLVTYTLRGKEKSEEFDAVVLSLPAYAAAQVLKETSRELSELLASIEYSPISVVALGFEKRGLGHNLDGFGFLVPKVEGRKILGALWDSSVFPNRAPEGKALIRVMIGGARQPELALKSEEELTEIALKELKRIMKIRHYPEMVKVFRHEKGIPHYTIGHAEKVERIFKLGRELGNLFFCNNAYKGVGINDCTKSARETAEEVLNSLC

SEQ ID NO: 165 - protein, 462 aa, Ignavibacterium
MTKTIVVIGAGISGLTTAYLLSKRGFNIRILERKSEVGGSIESIKENGFLFDRGPNSALETTPLISQLVEELNLKDELLYANKAANKRYILRNNELHALPMSPPALIKTKLFSAKAKLRLLTEPFIGRSEDGYYQSLAEFVRRRLGQEFLDYAINPFVAGVYAGKPEELSVKSAFPKLYALEEKFGGLIIGTIRSIRERKKRAEKSKQSARMLSFKSGMISLPKAIANYFADKLILSAEVISVDKTAEGFIVSYRHSGIDEAIVCDAVLSTVPSYVAGNLFSKFDKKFKVHSDEIYYPPVLVYFLAYEKKNIGQTLDGFGFLIPEKENKSFLGALWSSVIFPYRADNNFATFTLFIGGSRYPDFVKEDRNKLLEKVRKEFEQLMKIKSDPVFSAYRFWEKAIPQYNIGYIEHERFFDEFEKQNPGLFISGNFRGGISVGDCIKNAELVANKICVQFTMHNVQ

SEQ ID NO: 166 - protein, 544 aa, Sorghum <genus>
MLARTATVSSTSSHSHPYRPTSARSLRLRPVLAMAGSDDSRAAPARSVAVVGAGVSGLVAAYRLRKSGVNVTVFEAADRAGGKIRTNSEGGFLWDEGANTMTEGELEASRLIDDLGLQDKQQYPNSQHKRYIVKDGAPALIPSDPISLMKSSVLSTKSKIALFFEPFLYKKANTRNPGKVSDEHLSESVGSFFERHFGREVVDYLIDPFVAGTSAGDPESLSICHAFPALWNLERKYGSVVVGAILSKLTAKGDPVKTRRDSSAKRRNRRVSFSFHGGMQSLINALHNEVGDDNVKLGTEVLSLACTLDGAPAPGGWSISDDSKDASGKDLAKNQTFDAVIMTAPLSNVQRMKFTKGGAPFVLDFLPKVDYLPLSLMVTAFKKEDVKKPLEGFGVLIPYKEQQKHGLKTLGTLFSSMMFPDRAPDDQYLYTTFVGGSHNRDLAGAPTSILKQLVTSDLKKLLGVQGQPTFVKHIYWGNAFPLYGHDYNSVLEAIEKMEKNLPGFFYAGNNKDGLAVGSVIASGSKAADLAISYLESHTKHNNLH

SEQ ID NO: 167 - protein, 456 aa, Desulfurobacterium
MKVAVIGAGISGLSVAFYLKKGGAEVKVFEKEKTVGGKMKTIHEDGYIIETGPNGFLDGKPYTLNLVKELGIESKLYRSSDKARKRFIYTNGRLVRLPESPIAFLASYLLSWKGKLRLVGEFLVPPKKEDIDESLSEFAKRRIGEEALEKLLDPMVAGIFAGDPDRLSLKAAFPAIYYLEKQYGGLIKGLIAKMKEAKKSGKKSGPAGPGGVLTSFKGGVKDLIDSLSEFLGDSIETEVEILGLDRIEKGWKVKYKKENEVFEETFDAIVFSTPAYITAKLLNDLNLELSKLLSEIEYSPISVVALGFEKKGLGHDLDGFGFLVPRSEKRKILGALWDSSVFPNRAPSGKALIRVMIGGARQPELALLPDEELVNIALKELRRIMKIRHYPEKIKVFKHEKGIPHYTVGHAERVEKIFRLISKYPGLYLCNNAYTGVGVNDCTKAAEEVARRILDG

SEQ ID NO: 168 - protein, 446 aa, Acidithiobacillus
MEDVIIIGAGISGLATAYFLRKQGWSPLLLEAAAKPGGNLQSRQEEGYLRDMGPNSLMLKGHIVPEWLRELRLEEDIVEANPLAKRRYILNRHRQPVALGPGVLFGGGLLSWRGRLRLLGEPFRSPRRMQDSEESVADFVRRRLGEEALTWLVDPFISGVFAGNPARLSVQATLPRLIALEQDGGSLLRGALRARNKKSPDTPKTRLISFREGLQTLPLRVASALGDALRCNTPVEQLGNSDGSWQVSSGSQTWQSKRLILALPAGAAARLLAPTDAALAHELDAIPYPAVGSLSIGFQRMQVQHPLDGFGILIPRVMGLETLGILFSSTLFPGRAPADQVLLTAFIGGSQNDISGRDDDDLLATALREICPLLGISGKPVFSRCQTWPKAIPQYEIGHLDRIKRIDALSARHPGLYFRANWREGVALGDCMEEAYRFSQDVGWQR

SEQ ID NO: 169 - protein, 433 aa, Thermocrinis
MMDVIVVGAGISGLSVAFRLSKEGLKVKVLEKEEEPGGNIRTRKVGDFLCELGPQTVLADGEVVDFFREVGIQPQEASPSSSVRYIYKRGKLIPLPNSPVKFLTSPLLSLGGKLRVLMEPFVAPSVKTEETVAQFVRRRLGEEFLHYVITPFVRGVYAGDPEELSIKYAFRRVYQLEREYGSLIRAAIKLKRLGPPGKIISFEGGNQSIIQQLASYVDLETENVALRIRRKDDRYILDTKEGKYEARCVVVASPATSAGYLLRDISWSAAQELDKIYYAPVVVVHVATSQNIPDGFGFLAPQKEDLRILGVLFSSRIFPNKAPQGKELLTIYMGGATDPEVVEYEDELIMRIVEEDLRKSLGLTQLEFLLVTRWKRAIPQYTLGYGRYIELVEALQRENPGLFITGNYLEGVSVADCIKRSKRVVQEVVKFFR

SEQ ID NO: 170 - protein, 440 aa, Laribacter
MVVVIGAGISGLSCAWHLQQRGIPVVVLEAGSRVGGKIGTVAADGYRLELGPNTLYGHAGHLDLLERLGLTAAIRPAAAVVRHRFVLRGDRYEALPSGPLSFLTGSQFGARSKWLALTEPFRRNRPVREPETVAAFFRRRLGDEFVERAISPFVGGIFAGDPEELVAGLTLPVIHEAERQSGSIVRGMFARRKTFRRKATFTLNEGLQQLPETLAQGLDVRLDTSVQALERLETGWRVRTPAGELDADEVVLAVPADVAGQLLASHFPAIAANLANVTYAPVAVLHTAWPRSTVGHDLDGFGGLNPKVEKPFAAGSIWSGSLFPDRTPAGETLLTTFVGGMQFLDRYRHDDATLVALALEELRRLYRIQGEPTLCRLTRQEQAIPQYDSHALPLASAVSDLHEHGIRVCANWHGGVSVVDCLDKGQQVAVQCLLDYPPAS

SEQ ID NO: 171 - protein, 446 aa, Acidithiobacillus
MEEVIIIGGGISGLATAYFLRKRGWSPLLLEAGAAPGGNLQSRQEEGYLRDMGPNSLMLKGRIVPEWLRELQLEGDIVEANPLAGRRYVLNRHRQPVALGPGVLFGGGLLSIRGRLRLLGEPFQPPHPTPDGEESIADFVRRRLGDEALTWLVDPFVSGVFAGNPARLSVQATLPRLAALEQDGGSLLRGALRARKKKLPGTPKTRLVSFREGLQVLPLRVANTLGDTLRCDTPVDQLAYSGDMWQVGSGNQTWQSKRLVLALPAGAAARLLAQTDATLARELDAIPYPAVGSLSIGFRRPQVEHPLDGFGMLIPRVMGLETLGVLFSSTLFPGRAPAGQVLLTAFIGGSQNVLAGRDDDDLLATVLREIGPLLGISGDPVFSRCRVWPKAIPQYEIGHLDRMKRIDTLSAGHPGLHFRANWQGGVALGDCIEQAWEFSQTADWQH

SEQ ID NO: 172 - protein, 453 aa, Deferribacter
MKIAIIGGGISGISTAFWLEYFAKERLKSIDITIFEKNKRLGGTINTFYKDNFIIESGPNGFLDSKPYTVETFEKAGLGDNLIRSNELAKKRYIMRGGVLHKLPEKPNEFFSSKLLSFKGKLRVISELFIPAKKDEYDETIEEFAYRRLGKEAADYLISPMVSGVFAGDPSKLSLKSCFPVIYNLEKEYGGLFKAMFKKKGKKSGPAGPGGNLTSYKGGLIKGINALTEQLSNTKIYLGEEVTGLDKTNGSFKVKTTNSCDNYDIVIITSPAYVAAEFIKGLSVELSDKLLKLNYAPMYVIGFGFKEEDVLDPLDGFGFLVPHNENRKILGALFTSSIFPERAPKGYKLIRVMIGGDKNRWVLNCSEDELRDIAFNEIKDILGVKGNSVVEKSFYWERAIPQYYQGHEKLVEDIESICMDINNIYIGGNLLYGIGINDCTKRSIDIARGVLGG

SEQ ID NO: 173 - protein, 471 aa, Geobacter
MKKAIVVGGGISGLASAYLLREKAKNSGMELEITIVEKEDRTGGKIRSIKEDGYLCEWGPNGFLDSKPQTLDLCRELKVDSQLLRSNDNARKRFIYSGGVLNRLPENGPSFLKSRLISWPGKLRLALEPTPFIAKAPEGVDETLAAFGRRRLGDEALRKLIAPMVSGIFAGDPETMSLVSCFPRIAELEREYGGLVKAMVKLAKKKKQEIAEGKQVASAAGPGGVLTSFRDGIQTLTDILNERLGKDMLVIGAEVTGVSRGNSTPYRVQTGGRELDADIVVLATPAYATAQALEGIDGGMSATLNQIPYATMTVVCFGYEQEKVAHDLNGFGYLIPKAEGMNILGTLWDSSIFENRAPEGKVLLRSMMGGACFPEYIRLSDAEVVQKVRDNLKTIMGIKEAPEFVRIFRHEKAIPQYTVGHGRRLAALEEQAKSHPGLFLSGNSYRGIGLNDCVAAANRTADEVVAFLQSR

SEQ ID NO: 174 - protein, 450 aa, Thermodesulfovibrio
MGSAEIVIVGGGISGLSLAYFLIQKNSQLNIKIVEAEKRAGGKIITENISGFLCEGGVNGFLSNKPSTISLAKELNIEPLRGSESSKIRYILIDGKLIRVPENPIKFFLTPLLSFSGKIRMLREYFTPPLKEEIDETVESFVSRRVGKEFYEKLIDAMSTGIYAGDPSKMSMKSCFPKVYWLEKRHGGLLKGLIALKKEKKDTKAQPSGVLMSFKGGMSELIQSLERHLSSRILKGKKVLSIDRKNTYYTVHLDDGNFIEAEKVILACPAHESAEILKELSSELSDILKTIPYPPLSVVAFGFKKEQIGFGTSLYGFLIPYREQRKILGTLFDSSIFPNRAPESYVLLRSMIGGRRAPELAMLPDEKLIDTALSELKPLLNIKGDPEFIKIFRWEKAIPQYELGHEDKLNRIEQILSEFSGLYLTGNAYRGVSVNDCIENSLKLAEGIMV

SEQ ID NO: 175 - protein, 469 aa, Geobacter
MKKAIVAGGGISGLATAYLLKTRAAEEGLELDVTLVEREERLGGKIWSIKEEGYLCEWGPNGFLDSKPQTLDLCRELGASDLLLRSNDNARKRFIYTGGALNRLPENGPMFLKSGLISWPGKLRLAMEPFIPKKAGDEDETLAAFGRRRLGDEALRKLIAPMVSGIFAGNPETMSLRSCFPRIAELEDEYGSLVRAMIRLAKKKKQEVAQGKAVASAAGPGGVLTSFRDGIQALTDILAERLGPDTIVSGQEVLEVSRGGSLPWRVRTGSIDMDADLVILATPAYATASIIQGVDSDMAGILRQIPYATMTVVCFGYDRERIAHDLNGFGYLIPKEEGMNTLGTLWDSSIFENRAPEGQVLLRSMMGGACFPEYVNLTDEEVTGRVKNDLATIMGITAPPSFVRIFRHHQAIPQYTVGHSTRVAALEQRAASLPGLFLTGNSYRGIGLNDCVAAANRTAGEAIAQLTSR

SEQ ID NO: 176 - protein, 469 aa, Geobacter
MKKAIVAGGGISGLATAYLLKTRAAEEGLELDVTLVEREERLGGKIWSIKEEGYLCEWGPNGFLDSKPQTLDLCRELGASDLLLRSNDNARKRFIYTGGALNRLPENGPMFLKSGLISWPGKLRLAMEPFIPKKAGDEDETLAAFGRRRLGDEALRKLIAPMVSGIFAGNPETMSLRSCFPRIAELEDEYGSLVRAMIRLAKKKKQEVAQGKAVASAAGPGGVLTSFRDGIQALTDILAERLGPDTIVSGQEVLEVSRGGSLPWRVRTGSIDMDADLVILATPAYATASIIQGVDSDMAGILRQIPYATMTVVCFGYDRERIAHDLNGFGYLIPKEEGMNTLGTLWDSSIFENRAPEGQVLLRSMMGGACFPEYVNLTDEEVTGRVKNDLATIMGITAPPSFVRIFRHHQAIPQYTVGHSTRVAALEQRAASLPGLFLTGNSYRGIGLNDCVAAANRTAGEAIAQVTSR

SEQ ID NO: 177 - protein, 436 aa, Aquifex
MDMREVVVIGAGISGLSTAYRLKKEGVDVVVYEKDDRIGGTIHTVKEKGYLFEVGAQTILADQEVIDFLKEAGIEPVEASPSSKYRYIYKKGRLIPLPMSPVEFLKTPLLSLKTKLKVLTEIFKRGVDEDISIADFVREHFGEEFLNYVVAPFISGVYAGDPEKLSLKHATPKLYEAQKKYGSLIKAFIKEKTAGPKGKLISFGEGLGELINALAQKLEVHTENVVLRMRKFEDFFRLDVRGKKVETKSVVVASPAYTSSYLLKEVSFSASEEFDKIDYPPVVVVNVGVEGKFPKVRLLSSESGKKRILGAMFMSKLFPGRAPQGKELLTVFLGGATDREVIELSEEEIENIVERELKEILQIDCIDFMHVQKWKRAIPQYTLGYDRFLNLAQEMEKDYPGLFLTGNWLYGVSTADCIRASKKVAQKVLSFLRPQA

SEQ ID NO: 178 - protein, 470 aa, Pelobacter
MNISVVGAGISGLATAFAIQQQARRLGLEWTLDIFEKEDCSGGKIRSEKVDGYLCEWGPNGFLDSKPMTLDLCREAGLAEQLLRSNDAARKRFIFSGGRLQRVPESAADFFRSSLVSWPGKLRLAAELLVPRRKDLTDETLADFVRRRLGREALDQMVGPMAAGIFAGDPETMSLRSCFPRIHELEQQYGGLIRALLLLARKKRAERRAGKAVAGAAGPGGILTSFGGGIQELTDGLSRLLAPNLHLGDAVAAITPLKEGFSLRTHKGRVHETDIVVAAVPAMALATQVEGFSAPMAAQLRQIPYAPLQIACFGYRREALPLSLDGFGYLAARRSGMHSLGTLWSSSIFPGRAPAGYVLLRTMFGGATRPDAAQLSADEVQQRVEEDLSRSMGIKQAPDFVRIIRHTAAIPQYVSGHGARLKVLEDKAAAYPGLFLVGNAFYGVGLNDCVAAADRVASRVLTLMQQRQQA

SEQ ID NO: 179 - protein, 469 aa, Geobacter
MKKVIVVGGGISGLATAFELRNKGAEAGIELDVTLLEKEERVGGKIWSIKEEGYLCEWGPNGFLDSKPQTLDLCRDLGASERLLRSNDNARKRFIYTGGVLNRLPENGPTFLKSSLISWPGKLRLAMEPFISKRTDGTDETLASFGRRRLGEEALQKLISPMVSGIFAGDPETMSLRSCFPRIAELEDEYGSLIKAMIKLAKKKKQEAAQGKAVSSAAGPGGVLTSFRWGIQELTDILAEQLGSATVVTGQPVTGLTRGSSVPWRLKTPTVDIDADVVILASPAHATAGIVSGVDAAMAQVLGEIPYASMTVVCFGFERERIAYDLNGFGYLIPKDEGMNTLGTLWDSSIFENRAPEGKVLLRSMLGGACFPEYVKLSDAEVMQRVKADLKATMGITADPSFIRIFRHPQAIPQYTVGHGKRLAALQERSSALPGLFLTGNSYRGIGLNDCATAANRTTDEVVAYLKGR

SEQ ID NO: 180 - protein, 435 aa, Cytophaga
MIAIIGAGISGLTLAYQLQQAGKPYILFESNSRPGGYINSQRFGKYLLEVGPNSILVDKKLEEFIHELNLDKLFEPAAIINKNRFIYKDANIQQVPSGPLSFLTGRFFSAKTKYAIFKELFNKSISKENETVYDFFARRFSAPFTQYTIDPFATGVYAGDIKQLLIEETFPQLVELEKQYGSIIKGIFKKGFGEKRKTGTFVHGLQTLTDTLAAQLHSLQLNTRVLNLRKQMDKIVLTTDTKHGIEELTFDKVVVCGTTFQAATLIKDSYPDLSAILSQVQYASMKAVFAAFKRTDVTHPMNGFGCLYPSAEQSFLAGTIWNSSIFNDRCPADEVLTTSFIGGMHHPEYTALSESELEQRAIQQLSKDLGITGKPTFTHVAGWNKAIPQYDIYLKKARLASKLLSDDHIYFRSNWTNGISLGNCIQSARDLALIL

SEQ ID NO: 181 - protein, 471 aa, Geobacter
MKKAIIVGGGITGLATAWLLREKAKKAGMELEIALLEKEERVGGKIRSIKADGYLCEWGPNGFLDNKPQTLDLCRDLQADSQLLRSNDNARKRFIYSEGFLHQLPENGPSFFKSKLISWPGKLRLALEPTPFIAKAPDGVDETLAAFGRRRLGDEALRKLIAPMVSGIFAGDPETMSLQSCFPRIAELEREYGGLVMAMVKLAKKKKQELAEGKAVASAAGPGGILTSFRDGLQTLTEIIRGQLGCEVLSVGEEVVRIRKGSSVPYRVETTSRELDADVVVLATPAYATGQMLEGLDSAMTGILGQIPYATMSVVCLGYEQDKISHDLNGFGYLIPKGEGMNILGTLWDSSIFENRAPQGRVLLRSMMGGACFPEYIKLSDEEVQRRVCDNLKTIMGIAAPPDFVRIFRHEKAIPQYTVGHGKRLQALLDAGRNHQGLLLTGNSYRGIGLNDCVAAAVRSSNEVMEHLQKR

SEQ ID NO: 182 - protein, 465 aa, Porphyromonas
MDHLTVIIGAGLTGLTTAAFLRAAGRPVLVLERAAHIGGQIRTYREDGFVFETGPNTGTISSPEVAELFELLGLEPEIATPAASNRLIWKGNKLYPLPRNIAEAVATPLFSLWDKWRILGEPFRRRGGQPNETVGALARRRLGKSFVDYAVDPFLGGIYAGDPDQLVTRFALPKLYDLEQRYGSFVLGAVRKARQPQSERDRKASRKVFSVQGGLGLLVEALADYIGREHILTETQIRYINHPGAHTFGLTYTDASEEEHTIPCRHLVSTVAAHHIPTLFDHFPADESAVFEQLYYAPMIEVAVGFRRNVATHLPAFGCLIPSRENRRILGILFPSDCFRGRAPEGGALYSIFMGGVRNASLIDLSDEEISTIAMEELRDMLRIPHTCKPDLLHISRHRHAIPQYYADTELRQDIIRRMEMRWPGLHLGGNMHGGIGMAHRISQGVEMARSIIEETAIAERSARG

SEQ ID NO: 183 - protein, 464 aa, Corallococcus
MTVAVIGGGITGLALAYQLRARGTDAVVLESTSRVGGNVQTHARGGYLLEAGPNSFLDREPTTRELADALGVSSRIRPADVAAKNRYVFTRGALRALPTSPPAFLKSDILPLASRLRVVGELFSGRNPTGADESLAQLGRRHLGREATAVLLDAMQTGTYAGDPEQLSAEATFPQLVKFEREHRSLILGAIRAQRAARQAKGAVETGPRLTGQMSTFDGGLGVLVDALAKALGDSVRTDAKVEGLERAADGWTVRYQQRGQPAELSASHVVLAVPAHVAASLVRPLDAELAQKADAIPYAPIAVVHLGFAPGTVPKPDGFGFLVPAVEGTAMLGTIHVSTTFPFRVEGGRVLLTCLMGGARRPEVVSRDEDALVALAREELKAMAGLTATPELTAVFRWPRGIPQYTVGHLERLAAMEERLKRWPGLHLAGNAYRGVGVNDCLKEAARLAEALGGPAAGATRSA

SEQ ID NO: 184 - protein, 454 aa, Calditerrivibrio
MRVAIIGGGISGISTAFLLENLKNELNLDMEITIIEKRLRWGGSIETSREDGFIVEAGPNGFLDSKPHTLELLSMAGLSNNLVKSNDLARKRYIMRNGILHRLPENPPMFFKTKLLSFSAKMRILSEYFIQKSVLEDESVADFARRRLGKEALEYLISPMVSGIFAGDPEKMSLRSCFPVIRDLEINYGGLFKGMIKKKGKKSGPSGPGGILTSYKNGLDNMITDLLESTSITKMLNTEVFSIDKKINRYILNTNKGIMEFDKIFINAPAYAVSQMLSVLDKDLSRDLNNITYPPVFVAGFIFKPEDLEDPLDGFGYLIPHSENKRILGALFDSSIFPDRTRDGYKIVRTIMGGDKNRWIIEKSDDELIRMAFDDIKETLKIKREPYKIKYFRWEKAIPQYYIGHHKIVEKVEEFYKKFDDIFIGGNILYGVGINDCTRTSFMNVDRFKNLLNK

SEQ ID NO: 185 - protein, 465 aa, Porphyromonas
MDHLTVIIGAGLTGLTTAAFLRAAGRPVLVLERAAHIGGQIRTYREDGFVFETGPNTGTISSPEVAELFELLGLEPEIATPAASNRLIWKGNKLYPLPRNIAEAVGTPLFSLWDKWRILGEPFRRRGGQPNETVGALARRRLGKSFVDYAVDPFLGGIYAGDPDQLVTRFALPKLYDLEQRYGSFVLGAVRKARQPQSERDRKASRKVFSVQGGLGLLVEALADYIGREHILTETQIRYINHPGAHTFGLTYTDASEEEHTIPCRHLVSTVAAHHIPTLFDHFPADESAVFEQLYYAPMIEVAVGFRRNVATHLPAFGCLIPSRENRRILGILFPSDCFRGRAPEGGALYSIFMGGVRNASLIDLSDEEISTIAMEELRDMLHIPHTCKPDLLHISRHRHAIPQYYADTELRQDIIRRMEMRWPGLHLGGNMHGGIGMAHRISQGVEMARSIIEETAIAERSARG

SEQ ID NO: 186 - protein, 454 aa, Stigmatella
MAVIAVVGGGITGLALAHRLRSRGKDAVVLEAGAHLGGVIQTRQRDGFSTETGPNSFLDREPATRELAASLGIEERIRMADPSAKSRSLYTRGQLRPVPASPPAFLKSDLLPLGTRLRVLAELFTGRAPPGQDESLGDFGRRHVGARATSVLLDAMQTGTYAGDVEALSAEAAFPTLKQLEREHRSLLLGAVRTQGRQRAPAPAGTKLKGAMCTFEGGLGTLVEALARALGPAARTGAAVEGLARSQNGWRLSVRERGQQAELEASQVVLTSPAHVSAELLAPLDPSLAGHLKGIPYAPIAVVHLGFAPGKTPPPDGFGFLVPGQEQRQLLGVIHVSTVFPFRAEGGRVLYTCLMGGARRPDLVGLNEEALAALAQQELREMAGVTASPDFTEAVRWPRGIPQYTVGHLERLSAIDSALARLPGLHLAGNAYKGVGLNDCIRNAAALAETLASR

SEQ ID NO: 187 - protein, 465 aa, Porphyromonas
MDHLTVIIGAGLTGLTTAAFLRAAGRPVLVLERAAHIGGQIRTYRENGFVFETGPNTGTISSPEVAELFELLGLEPEIATPAASNRLIWKGNKLYPLPRNIAEAVATPLFSLWDKWRILGEPFRRRGGQPNETVGALARRRLGKSFVDYAVDPFLGGIYAGDADQLVTRFALPKLYDLEQRYGSFVLGAVRKARQPQNERDRKASRKVFSVQGGLGLLVEALADYIGREHILTETQIRYINHPGAHTFGLTYTDASEEEHTIPCRHLVSTVAAHHIPTLFDRFPADESAVFEQLYYAPMIEVAVGFRRNVATHLPAFGCLIPSRENRRILGILFPSDCFRGRAPEGGALYSIFMGGVRNASLIDLSDEEISTIAMEELRDMLHIPHTCKPDLLHISRHRHAIPQYYADTELRQDIIRRMEMRWPGLHLGGNMHGGIGMAHRISQGVEMARSIIEETAIAERSARG

SEQ ID NO: 188 - protein, 462 aa, Leptospirillum
MSTVFRCDVLIVGGGISGLAAAMVLHQAGKNILLVESRGYLGGAIRSVEDSGYLLEMGPNSMMLGPEDPINVWLDKLGLSEKLLKASPEAQNRYVWCQGKLIPVPLSPSSFLTTPLFSLSEKMRVAKEFFISPGSGLPEGSDETVGHFVRRRLGNEFLEKLIDPFVKGVYASHPDLLSLNSAFPLLARLEQESGGLIRGAIRLSREKKRKKANLTGPPGGLYSFSGGLGEMVRAFSGYLKDESLIHGELIHWNRLPSGEFQCVLLQDEERVEVISQKMILATSPADAGRILEKNQPEIASVLSSIPMAPIAIAYIGVDRKALPGYLPGFGVLFPTSEKRKILGIIQNSDLFPNRSPDGKVLLTIFAGGMLSPKIAMSFDEDFEQIVLGELKTVFGLDSRPEFFRIQRWAEGISQYSPGHASRIQRIRDLTPEGMILTGNYLGGISVLKTFTNGLEAGKAFLS

SEQ ID NO: 189 - protein, 454 aa, Spirosoma
MTIGIIGAGISGLTLAYELQRRGIAYHLWEAAGQAGGYIRSQRDWPDGPSGRNYLRELGPNSLLGDAELLNWLDELGLTPELTFSQPVSKARFIFRDGKYRQLPSGPPSLLFGNFFSWKTKLAILRERNNKTVSPPGETLGQFFRRRFSSEIVDYALGPFVAGIYAGDPEQLLVSETFPSLLQYEKEYGSVLRGLIKSQSAGGSAIGRRQSFSFREGMQMLPNALAAKLTNLSLNEAVSSISPTPNGWEVETNTGTTTVDKLVLAVGTDAAARLVDQRYPDLARTLQAITYPPMTAVHSAYKRADVRHPLNGFGGLNPAVEGRFAAGHIWSSSIFTGRCPDDEVLFTTFVGGQTGAHNTRHPDSVLAHNVHKELVDGFGITAATPVYQSVFRWERAIPQYDATLASAKESVKAMEADQLFVCANWYGGVSLSDCIGKSRKLADQLAVKPFIKNF

SEQ ID NO: 190 - protein, 495 aa, Candidatus Legionella jeonii
MATEQHSGSRRIVVVGSGIAGLAAAYRLQERCEQDGPPCEVRVLEAAARPGGAISTTHRDGFVLESGPDTIFTDKPWGLDLIRRLGLSEQVIGTNEAHRRTFVVRDGALHPLPEGFALMGPTKPWPFLQSGLLSWRGKARAALDLVLPRGGPSDDESLASFVRRRFGQEFLDRLAQPMIGGIYGADPERLSLRATFPQFLQMEATHRSVILGLRRMRPAGRGVGHTSSGPRYGLFVTLDHGLQALVDAMVKRLPAGTLRLRAPVDRIAHTEQGWTVRLGDGASLQADGLILAVPAFEIARLTHDLDQDLARQLEAMPYASSVTINLAYRREAIHHPLDGFGFVVPACEGRTIIACSFSSVKFAHRAPAGHVLLRAFAGGALQPEPFTWDDETLLSAVRRDLEELLAIHAPPLWSQLVRHPRVMPQYQVGHLGRLAALEETLRRWPTLKLTGNAYRGVGVPDVVHSGETAADSLLAELAPSPTEPTPACTEGDSRL

SEQ ID NO: 191 - protein, 469 aa, Pelobacter
MKRAIIVGGGISGLATAWLLREKALACGIQLELVLLEKDQRPGGKIRSIHEGGYVCEWGPNGFLDSKPQTLELCDAVGVSSDLLRSNDNARKRFIYSDGELHRLPEGGGTFLKSRLISWPGKLRLALEPTPFIARTPAGVDESLADFARRRLGGEALDKLISPMVSGIFAGDPETMSLVSCFPRIAQLEREYGGLIRAMVRLARQKKRERAAGKAVSSAAGPGGVLTSFRPGIQYLTDSLAASLGGIVMADREVSWVRRGKSAAWRVGCRDGGEYDADLVIVASPAHAASAILHDCDAGIASILESIPYASMTVVCLGYERELVSHPLDGFGYLIPKKEGRSILGTLWDSSMFENRAPTGKVLLRSMVGGACFPDYVHMGDDELLGRVRGDMKDVMGIVAEPSFIRIFRHPQAIPQYTVGHGERLKHLEERLACHPGLILTGNSYRGIGLNDCVAAAQRASDQALELLR

SEQ ID NO: 192 - protein, 436 aa, Aquifex; identical to SEQ ID NO: 177

SEQ ID NO: 193 - protein, 495 aa, Candidatus Legionella jeonii; identical to SEQ ID NO: 190

SEQ ID NO: 194 - protein, 457 aa, Unknown
  Unknown
MGVEVAIIGAGISGLSVAFFLKRAGAGVLVLEAEEDVGGTMRSRRFKGYLIELGPNSALETTPLFQELIAAAGLAGERVYASEAARNRYIVRGGELHPLPLTPLAFLRSRLWSWKGKLRVLAEPFHGRADREESVADFARRRVGQEFLDYAVNPFVAGIYAGDPERLSVRFAFPRLYALEAQYGGLFLGMLRGARERRRRGEAPKIAARLFSFREGMGALPRALAAALGNTVWCATRALCVERAGAAFEIAFERDGRRDTLRAERVVLATPAYAAASLLKRLAPEAARALDRIVYPPVSAVILGYPETAIGRPLDGFGFLVPEKEQRRILGTIWNSTIFPARAPQGFVTLTTFVGGMRQPELARRPNEELIALVAEELTDLLRLRGEPEFAYVSRWERAIPQYELGYGEILDALDRAEREHVGLYFCANYRGGIAVGDCVMSAHATAERILRDRARS

SEQ ID NO: 195 - protein, 462 aa, Unknown
  Unknown
MAGFDCDTLVVGGGVSGLAAALTLKNRGVDVRLLESRGYLGGAIRTVREDGYLLEFGPNSLMVRPEDAIDTVLGDPELRARIVPASGLSKNRYVVKAGHLYPVPLSPWAFFRTPLLSWRGRRDILSEWKVPPRTGGPEETLSHFVRRRLGEEALDYFVDPFVKGVYASHPDLLSVEAAFPLLVRLEREHGGLLRGALKTFLKRRKRPSGSSPRGIFSFAGGMTDLVEAMGKRLGEDVGTNVDVIKYTRLEEGFRVALMYDETEYYMTSRRLILATSAPQAAELLEGDPDGPSSELKSIPYAPVTIAYAGFLREQVTHPLDGFGLLCPTVENRKVLGVIFSSSLFPGRAPEGKVLLTVFVGGMTGQKLAQAFDEDLERIVLKELTELLGVKGAPSFFRIHRWEKAIPQLILGHGETVRTIRKKLPSGLRLAGNYLDGISIARAFASGVRAAEELLSEDGGTPG

SEQ ID NO: 196 - protein, 467 aa, Unknown
  Unknown
GCAAAYKLKLHGLNVTVFEADERVGGKLRSVSQDGLIWDEGANTMTESEADVSSLIDDLGLRDKQQFPISQHKRYIVRNGKPVLIPSNPIALIRSSFLSTQSKVQILLEPFLWKKTKSSDEPESVGGFFQRHFGKEVVEYLIDPVVAGTSGGDPESLSMRHAFPELWDLERRFGSIISGAFQSMVSSRGGKRKPSGNSKRRRGSFSFFGGMQTLTDALSKEIGPHEINLQSKVLEMSYSCDDNAVGNWSIYCAPDQNKQFQQSFDAVIMTAPLNNLKEMKITKTGSPFLLNFIPEVSYLPISVIISTFKKENVKQPLEGFGVLVPAKEQENGLRTLGTLFSSMMFPDRASEDVYLYTTFVGGSRNKELAKASRDELKQIVTSDLRQLLGTEGEPKFLTHYYWSKAFPLYGRDYGSVIEAIEKMEKELPGYFYAGNHKGGLSVGKAISSGCKAAESVIAYLDSYSNQK

SEQ ID NO: 197 - protein, 535 aa, Amaranthus
MVIQSITHLSPKLALPSPLSVSTKNYPVAVMGNISEREEPTSAKRVAVVGAGVSGLAAAYKLKSHGLNVTLFEADSRAGGKLKTVKKDGFIWDEGANTMTESEAEVSSLIDDLGLREKQQLPISQNKRYIARDGLPVLLPSNPAALLSSNILSAKSKLQIMLEPFLWRKRNATELSDEHVQESVGEFFERHFGKEFVDYVIDPFVAGTCGGDPQSLSVHHTFPDVWNVEKRFGSVFAGLIQSTLLSKKEKGGGENASIKKPRVRGSFSFHGGMQTLVDTMCKQIGEDELKLQCEVLSLSYNQKGIPSLGNWSVSSMSNNTSEDQSYDAVVVTAPIRNVKEMKIMKFGNPFSLDFIPEVTYVPLSVMITAFKKDKVKRPLEGFGVLIPSKEQHNGLKTLGTLFSSMMFPDRAPSDMCLFTTFVGGSRNRKLAKASTDELKQIVSSDLQQLLGTEDEPSFVNHLFWSNAFPLYGHNYDSVLRAIDKMEKDLPGFFYAGNHKGGLSVGKAMASGCKAAELVISYLDSHLYVKMNEKTA

SEQ ID NO: 198 - protein, 493 aa, Silene
TSDPDKLQSSAKRVAVIGAGVSGLAAAYKLKSNGLNVTLIEADERAGGKIRSAAKNGYIWDEGANTMTESESEVTSLLDDLGIRDKQQLPLSQNKRYVVRDGLPVLLPSGPISIFTSNFLSPKSKLRLLCEPFSWRRRDNAKVSDEQADESVSDFFGRHFGEEFVDYLIDPFVGGTSAADPKTISMRHSFPELWDIEDRFGSIIAGAIQSRLTPKPGEQKKPVKKTRVRGSFSFKGGMQTLVDTICERFSEDELKLKCKVLSLSYSHEGHSNNWSLSCLSNKSIEDRPYDAVVVTAPLTNVKDMKILNGGSPFSLDFVPEVDYLPVSIIVTAFKKANVERPLEGFGVLIPSKEQEKGLKTLGTLFSSMMFPDRSPADQYLYTTFVGGSRNRELARATTDELKQVVLSDLQQLLGVKGDPSFINHVYWSKAFPRYGQNYESVKMAIAKMENDLPGFFYAGNHKDGLSVGKALASGYKAADLVMSYLNSYSNTNQ

SEQ ID NO: 199 - protein, 493 aa, Silene
TSDPDKLQSSAKRVAVIGAGVSGLAAAYKLKSNGLNVTLIEADERAGGKIRSAAKNGYIWDEGANTMTESESEVTSLLDDLGIRDKQQLPLSQNKRYVVRDGLPVLLPSGPISIFTSNFLSAKSKLRLLCEPFSWRRRDNAKVSDEQADESVSDFFGRHFGEEFVDYLIDPFVGGTSAADPKTISMRHSFPELWDIEDRFGSIIAGAIQSRLTPKPGEQKKPVKKTRVCGSFSFKGGMQTLVDTICERFSEDELKLKCKVLSLSYSHEGHSNNWSLSCLSNKSIEDRPYDAVVVTAPLTNVKDMKILNGGSPFSLDFVPEVDYLPVSIIVTAFKKANVERPLEGFGVLIPSKEQEKGLKTLGTLFSSMMFPDRSPADQYLYTTFIGGSRNRELARATTDELKQVVLSDLQQLLGVKGDPSFINHVYWSKAFPRYGQNYESVKMAIAKMENDLPGFFYAGNHKDGLSVGKALASGYKAADLVMSYLNSYSNTNQ

SEQ ID NO: 200 - protein, 501 aa, Solanum
MAPSAGEDKQKRVAVIGAGVSGLAAAYKLKVHGLNVTVFEAEGRAGGKLRSLSQDGLIWDEGANTMTESEGDVTFLLDSLGLREKQQFPLSQNKRYIARNGTPTLIPSNPFDLFKSNFLSTGSKLQMLFEPLLWKNKKLTKVSDKHESVSGFFQRHFGKEVVDYLIDPFVAGTCGGDPDSLSMHLSFPDLWNLEKRFGSVIVGAIQSKLSPIKEKKQGPPRTSINKKRQRGSFSFLGGMQTLTDAICKNLKEDELRLNSRVLELSCSCSGDSAIDSWSIFSASPHKRQAEEESFDAVIMTAPLCDVKSMKIAKRGNPFLLNFIPEVDYVPLSVVITTFKKESVKHPLEGFGVLVPSQEQKHGLKTLGTLFSSMMFPDRAPNNVYLYTTFVGGSRNRELAKASRTELKEIVTSDLKQLLGAEGEPTYVNHLCWSKAFPLYGHNYDSVLDAIDKMEKSLPGLFYAGNHKGGLSVGKALSSGCNAADLVISYLEAVSADTKNHS

SEQ ID NO: 201 - protein, 463 aa, Unknown
  Unknown
MATEDVETLVIGGGIAGLACASHLKLAGRTVRLVERNDYLGGVIRTLSDSGYRIETGPNSLLVRTEEPLLKYLSRPEIAARIQLAGRMGKKRFILKDGHPVALPMSLSEGIFTQILSLPAKVRLLKEPFIPPAGGVDGVDPEKETVADFVRRRLGNEFLESLIDPFVKGVYASDPHLLSMADTFPRLVQMEKSYGSLIKGGLALARQKKAPAPAFAREILSFSEGMGTLPESLANILDDDAGTNAEVIGCAPSESGFRTALLFEEETYYIRSKHLVLALPAAQTAELIEPMAPGIPSLLGQIPYAPIAVVYLGYPRDRISHPLDGFGLLVPSRERRKILGALFSSSLFPGRSPDGHVLLTVFVGGMTQPKLAQAFDEDLLPMVTKEIGSMLGVLGAPSYVRIQRWAGAIPQSVPGHGERIRSIESALPSGLHLAGSYLSGVSVSQTFSSGIRAAEKILAQSPG

SEQ ID NO: 202 - protein, 544 aa, Zea
MLALTASASSASSHPYRHASAHTRRPRLRAVLAMAGSDDPRAAPARSVAVVGAGVSGLAAAYRLRQSGVNVTVFEAADRAGGKIRTNSEGGFVWDEGANTMTEGEWEASRLIDDLGLQDKQQYPNSQHKRYIVKDGAPALIPSDPISLMKSSVLSTKSKIALFFEPFLYKKANTRNSGKVSEEHLSESVGSFCERHFGREVVDYFVDPFVAGTSAGDPESLSIRHAFPALWNLERKYGSVIVGAILSKLAAKGDPVKTRHDSSGKRRNRRVSFSFHGGMQSLINALHNEVGDDNVKLGTEVLSLACTFDGVPALGRWSISVDSKDSGDKDLASNQTFDAVIMTAPLSNVRRMKFTKGGAPVVLDFLPKMDYLPLSLMVTAFKKDDVKKPLEGFGVLIPYKEQQKHGLKTLGTLFSSMMFPDRAPDDQYLYTTFVGGSHNRDLAGAPTSILKQLVTSDLKKLLGVEGQPTFVKHVYWGNAFPLYGHDYSSVLEAIEKMEKNLPGFFYAGNNKDGLAVGSVIASGSKAADLAISYLESHTKHNNSH

SEQ ID NO: 203 - protein, 507 aa, Oryza
MAASDDPRGGRSVAVVGAGVSGLAAAYRLRKRGVQVTVFEAADRAGGKIRTNSEGGFIWDEGANTMTESELEASRLIDDLGLQGKQQYPNSQHKRYIVKDGAPTLIPSDPIALMKSTVLSTKSKLKLFLEPFLYEKSSRRTSGKVSDEHLSESVASFFERHFGKEVVDYLIDPFVAGTSGGDPESLSIRHAFPALWNLENKYGSVIAGAILSKLSTKGDSVKTGGASPGKGRNKRVSFSFHGGMQSLIDALHNEVGDGNVKLGTEVLSLACCCDGVSSSGGWSISVDSKDAKGKDLRKNQSFDAVIMTAPLSNVQRMKFTKGGVPFVLDFLPKVDYLPLSLMVTAFKKEDVKKPLEGFGVLIPYKEQQKHGLKTLGTLFSSMMFPDRAPNDQYLYTSFIGGSHNRDLAGAPTAVLKQLVTSDLRKLLGVEGQPTFVKHVHWRNAFPLYGQNYDLVLEAIAKMENNLPGFFYAGNNKDGLAVGNVIASGSKAADLVISYLESCTDQDN

SEQ ID NO: 204 - protein, 542 aa, Setaria <grass>
MLSSSTTTASPASSHPYRPAYPRASLRPVLAMAGSDDPRAAPARSVAVIGAGVSGLAAAYRLRKSGVNVTVFEAADRAGGKIRTNSEAGFLWDEGANTMTEGELEVSRLIDDLGLQDRQQYPNSQHKRYIVKDGAPALIPADPISLMKSSVLSTKSKLALFLEPFLYKKSNTRNSGKVSDEHLSESVGSFFERHFGREVVDYLIDPFVAGTSAGDPESLSIRHAFPALWNLERKYHSIIVGAILSKLTAKGDPVKTGSDLSGKRRNRRASFSFHGGMQSLINALHNEVGDDNVKLGTEVLSLACTFDGLPSTGGWSISVDSKDAGSKDLAKNQTFDAVIMTAPLSNVQRMKFRKGGAPFVLDFLPKVNYLPLSLMVTAFKKEDVKKPLEGFGVLIPYKEQQKHGLKTLGTLFSSMMFPDRAPDDQYLYTTFVGGSHNRDLAGAPTSILKQLVTSDLKKLLGVEGQPTFVKHIYWRNAFPLYGRDYGSVLDAIEKMEKNLPGFFYAGNNKDGLAVGNVIASGSKAAELAISYLESQTKHNNSH

SEQ ID NO: 205 - protein, 507 aa, Brachypodium
MAASDDPRAAPARSVAVVGAGVSGLVAAHRLRKSGVRVTVFEADDRAGGKIRTNSDSGFLWDEGANTMTESALEASRLIDDLGLQDKQQYPNSQHKRYTVKDGAPTLIPSDPIALMKSTVLSTKSKFKLFLEPFLYEKSHTRNSQKVSDNHLSESVGSFFERHFGKEVVDYLIDPFVAGTSAGDPESLSIRHAFPGLWDLEKKYGSIIVGAILSKLTAKGDSTKKADTSSGKGRNKQASFSFHGGMQTLVEGLHKDVGDGNVKLGTQVLSLACSCDRLSASDGWSISVNSKDASSKLAAKNQLFDAVIMTAPLSNVQRMKFTKGGVPFVLDFLPKVDYLPLSLMVTAFRKEDVKRPLEGFGVLIPYKEQQKYGLKTLGTLFSSMMFPDRAPNDQHLFTTFVGGSHNRDLAAAPTAILKQLVTSDLRKLLGVEGQPTFVKHVHWKNAFPLYGHDYDLALEAIGKMENELPGFFYAGNNKDGLAVGNVIASGSKTADLVISYLESHQAR

SEQ ID NO: 206 - protein, 551 aa, Oryza
MLSPAATTTTTTSYCSYSSRAHAPTRSASAGAARFRPARAMATSDNDPRGAAPARSVAVVGAGVSGLAAAYKLRKRGVQVTVFEAADRAGGKIRTNSESGFIWDEGANTMTESESEAGRLIDDLDLQGKLQYPNSQHKRYIVKDGAPTLIPSDPIGLMKSTVLSTKSKLKLFLEPFLYEKSSKRNSGKVSDEHLSESVASFFERHFGKEVVDYLIDPFVAGTSGGDPESLSIRHAFPALWNLENKYGSVIAGAILSKLSTKGESVKTGGATPGKGRNKRVSFSFHGGMQSLIDALHNEVGDGNVKLGTEVLSLACSCDEISSSGGWSIAVDSRDAKGKDLRKNQSFDAVIMTAPLSNVQRMKFTKNGAPFVLDFLPKVDYLPLSLMVTAFKKEDVKRPLEGFGVLIPYKEQQKHGLKTLGTLFSSMMFPNRAPNDQYLYTSFIGGSHNRDLAGASTAILKQLVTSDLRKLLGIEGQPTFVKHVHWGNAFPLYGRNYDLVLEAIAKMEKNLPGFFYAGNNKDGLAVGNVIASGSKAAELVLSYLESHTDQDN

SEQ ID NO: 207 - protein, 494 aa, Picris
MAEHIHTDQNDKRPLKSVAVVGAGISGLAAAYRLKSQGLAVTIFEADGTTGGKIKSFAQNGLIWEKGANTMTETEPEVGKLIDDLGIRGKQQFPIMQSKRYIVRDGKPQLLPSNPVAFIGSKTLSAQAKLNIFLEPILWKHKNSKEKTPNSPDIYQEESVGDFFRRHFGQEVVDYIVDPFVAGTAGADAESLSIRHMFPEIWDLEERFGSIITGAIKSSWSRKKAQRDAKHVTHGQKRQRGSFSFMGGLQTLTNALSKKLGEESLRMHCSVLSLSCNLQGNPPHNNWSVCYARNDASYKEPLKEQSFDAVVMTVTYLPMSIIITTFKKQDVKHPLEGFGILVPSKEEKNGFQTLGTLFSSNMFPDRAPTDQYLFTTFIGGNRNRKLAKSQLKDLQEVAVNDLNKILGVGSDPLSVKHIYWNEAFPLYSLDYNSVVAAIDKLGKSLPGIYFAGNYRGGLSVGKALTSGFKAADLAISDFNSKGLCTMIGTDHEVK

SEQ ID NO: 208 - protein, 506 aa, Oryza
MAASDDPRGGRSVAVVGAGVSGLAAAYRLRKRGVQVTVFEAADRAGGKIRTNSEGGFIWDEGANTMTESELEASRLIDDLGLQGKQQYPNSQHKRYIVKDGAPTLIPSDPIALMKSTVLSTKSKLKLFLEPFLYEKSSRRTSGKVSDEHLSESVIFLCICRDNQVVDYLIDPFVAGTSGGDPESLSIRHAFPALWNLENKYGSVIAGAILSKLSTKGDSVKTGGASPGKGRNKRVSFSFHGGMQSLIDALHNEVGDGNVKLGTEVLSLACCCDGVSSSGGWSISVDSKDAKGKDLRKNQSFDAVIMTAPLSNVQRMKFTKGGVPFVLDFLPKVDYLPLSLMVTAFKKEDVKKPLEGFGALIPYKEQQKHGLKTLGTLFSSMMFPDRAPNDQYLYTSFIGGSHNRDLAGAPTAILKQLVTSDLRKLLGVEGQPTFVKHVHWRNAFPLYGQNYDLVLEAIAKMENNLPGFFYAGNNKDGLAVGNVIASGSKAADLVISYLESCTDQDN

SEQ ID NO: 209 - protein, 465 aa, Unknown
  Unknown
MDHLTVIIGAGLTGLTTAAFLRAAGRPVLVLERAAHIGGQIRTYREDGFVFETGPNTGTISSPEVAELFELLGLEPEIATPAASNRLIWKGNKLYPLPRNIAEAVGTPLFSLWDKWRILGEPFRRRGGQPNETVGALARRRLGKSFVDYAVDPFLGGIYAGDPDQLVTRFALPKLYDLEQRYGSFVLGAVRKARQPQSERDRKASRKVFSVQGGLGLLVEALADYIGREHILTETQIRYINHPGAHTFGLTYTDASEEEHTIPCRHLVSTVAAHHIPTLFDRFPANESAVFEQLYYAPMIEVAVGFRRNVATHLPAFGCLIPSRENRRILGILFPSDCFRGRAPEGGALYSIFMGGVRNASLIDLSDEEISTIAMEELRDMLHIPHTCKPDLLHISRHRHAIPQYYADTELRQDIIRRMEMRWPGLHLGGNMHGGIGMAHRISQGVEMARSIIEETAIAERSARG

SEQ ID NO: 210 - protein, 505 aa, Oryza
MAASDDPRGGRSVAVVGAGVSGLAAAYRLRKRGVQVTVFEAADRAGGKIRTNSEGGFIWDEGANTMTESELEASRLIDDLGLQGKQQYPNSQHKRYIVKDGAPTLIPSDPIALMKSTVLSTKSKLKLFLEPFLYEKSSRRTSGKVSDEHLSESMFSDQREYICSVIFLCICRDNQVVDYLIDPFVAGTSGGDPESLSIRHAFPALWNLENKYGSVIAGAILSKLSTKGDSVKTGGASPGKGRDKRVSFSFHGGMQSLIDALHNEVGDGNVKLGTEVLSLACCCDGVSSSGGWSISVDSKDAKGKDLRKNQSFDAVIMTAPLSNVQRMKFTKGGVPFVLDFLPKVDYLPLSLMVTAFKKEDVKKPLEGFGALIPYKEQQKHGLKTLGTLFSSMMFPDRAPNDQYLYTSFIGGSHNRDLAGAPTAILKQLVTSDLRKLLGVEGQPTFVKHVHWRNAFPLYGQNYDLVLEAIAKMENNLPGFFYAGKSMKAPLLYKRNLRYLKHIPVD

SEQ ID NO: 211 - protein, 461 aa, Salinibacter; identical to SEQ ID NO: 138

SEQ ID NO: 212 - protein, 469 aa, Rhodothermus; identical to SEQ ID NO: 139

SEQ ID NO: 213 - protein, 483 aa, Tribolium <grass>
NMSLRLVLFLVFCIGKVLGNFSVIVIGAGPSGIAAATKLLQHSVNVTVLEAENRIGGRINTVKFGDGLVELGAEYCHGEVGNIVKELVNGYDLLEPNFNYLNGEIYYSNGSKLDHGFVREMQDLILSENKEENYDTRGKSIGEVFMHKYNSTLVEKYKSDENKLKLLKEGLHFAERSILISEGSFSWFDASADSDWLECPGNQTLVWKGVGYKTVLEILMKSYPNPDEKLPLDDKLFLNSKVTKINWGEKPIKVHTSDKVYSADYVIFTPSIGVLKAGSDLFTPSLPPKKHKAIDSIGFAGVVKLFLRFPVKWWDDNDKYFAFFWSDDDLKSENFPEGPPEKRKIVGYPAVGLVPSWAQHQRLDDLDLGEMVPEIEQLPIETLKKGVNFTLEKFLGKDYNITEIGEVLRSGWVTNENFRGTYSFTRNGLYQKGVSYQNDLAEPLEGLFFAGEATNPVHFATVHGAIESGHREARRILDPRNKN

SEQ ID NO: 214 - protein, 453 aa, Tribolium <grass>
SVIIVGAGVSGISAAVKLFENGIANLKIFEAEDRIGGRIHTVKFGDNFIDLGAQYCHGENVVYDTVKDLDLLEHAQLFSTPKMYYSNGSHLDNQLTQDLQKVVSSYDHDITRSKELSLGDAFLKKYNSTILEKYKNDPENFKLASDGLTFAHSTILMHEGAFHWSRPASGRHYKAVKGDQMMVWKQRGYDMILDVLLKRYPDPSLKIPIEEKLFLNKRVTKITWTGDKASVKLSDGTSHEADHVIFTPSVGVLTHDDLFEPVVPPRKQQAIKSMGFDGIIKLILYFPEKWWHDSDSTFFFLWDRKDLEGITKEFNEGPSKDGISWVSNLVALVKVPSNPHVLIGWVSGGLIPEMEKMSLDVVKKGSMFVIRKFLGRDYNVTEPGEVLWSDWHNNPNFRGTYSYEKNGYFEEEVHYQDHLAEPLTQGTTPVVLFAGEATHPTHYSTVHGAIESG

SEQ ID NO: 215 - protein, 612 aa, Mycosphaerella
MASSSSPNHGKKAIVIGAGVGGVSTAARLAAAGFSVTVLEKNSFTGGRCSLIHHDGYRFDQGPSLLLLPHLFHATFADLGTTLEKEGVHLLKCEPNYNIHFGDGEKFTLSTDLSVMKEEIEKWEGKDGYDRYLAFLRESHAHYELSVTHVLLKNFTSLLSMLRISFLQHLVALHPFESIWSRASRYFWTERLRRVFTFGSMYMGMSPFDAPGTYSLLQYTELAEGIWYPVGGFHKVVGALVGIAERMGAEFRLETAVKRICVTADGARATGVELENGEVLEADVVVNNSDLVYAYNHLLQPQAYAESLSDRPGSCSSISFYWALDRKVPELSAHNIFLADDYRESFDSIFKKHLIPDQPSFYVNVPSRVDSTAAPEGKDTVVVLVPVGHLTGEAAASHFSQPASSPSKPNGGTIKSASPSTQTGIPPTLDQDWPAMIALARQTIIKTIHHRTGVDLHPLIIHEQSNDPVTWRSAFNLDKGAILGLSHSFFNVLCFRPSTRARRAGPLDPLLKYLSGLYMVGASAHPGTGVPIVLAGGKLVAEQVCGDMGVRVPWVVEEGRGKGKEEVKKLDRMEKPETWVKWVGILIALGMVPWILGWVVVLFLAKVASVGW

SEQ ID NO: 216 - protein, 936 aa, Mycosphaerella
MSIDTEEATCQVPVELSAGSESEEELNDIAEHELEDDFDPHFHREGQATPMVDIAGPASESQHQQPPAFSRWVSKLRRKRHNHPQLLSPRKERWTLDDFDTRAASPGQQYLSPGRHYHSDSQGSSVRFVTAVRSATATLASASMATLSRRTTRFRRGHQRSSIVSGSEIRLSIESRRSIIDEAAKQRARKRREKLEELIRTEESYVADVKALSNAYFTILAHQPTATSFARTSTQRTIADILHLHDDILGCLHRIVPFAEYDQTIARLPLPLRAHNRWHSMDAVPQRTTPNRSTLATIRQGRRSLNISRSSSDDAQVVLRCSPQTIAAVAKAFSDNMLRFAAYEDYGANYDLIQRDVDDTQRAISGWADFDKAIEAISAHVNPMRTREANRKRAMTVKDLLIKPIQRLPRYELLFSDLHKLTPACDDPISHAEIEELRLKLNSVCHRMNAAKENPARARALEMTWLIGDRLTFSSQVPRSIFLQLLGRVSLCGSLYIAYRSRDRIKGAYVICVLFESCLLLASCDEDQSKYSILVSITLANATIEETDNAKGLQCHTAPHAWKVVFEQGARMYELIFTACSAVESEVWRTHIASGIETQIAAVAEGKANVFELQSPLTADMKSIGKAFGKPGSFVRRMSVQRAATIGPTADLNQVIIKNTQAVKEVMDNSSQGSFQIPRSQSVATPSHVQTLAPRRADRHRLETILSDVWSRDLLPYPGMVRRSDPIRAGANHVIRKFSMASITSNFSSSKRTGSYTSMSSWRKEDMPPPRNRGESGREGSSMSSRQSRPPLIDFHTAPDAFLPADFEIGRPSKDKRKRSALRTFTMTMERPFTPLLGNENKQSGLRRAQSVKDVVDDQARPGPSPIQLKRREEKRTGTPVYSVVQERARTPAMLHVKDESLEMGMGVGEASNGAVAGKAPRKSKSRLLRLFGQER

SEQ ID NO: 217 - protein, 573 aa, Mycosphaerella
MLHSRSCTYRLLAPAVARRITPLVPSQCLLQTHRSRTYSAEAAPSHDVAVLGGGITGLAAAHYVTREHPRAKVTLYEASDRVGGWVSSKRADVHDGTVLFEGGPRTLRPNGNGVLAANASQMQELDLTKDAIFTQKSSPAAQNRFVYYPDHIVRMPHPSAGLFNNLWSLMTEPVFATALKSGFMEAFTTGRDGSIQDESIAEFFSRRLSPTMVDRILSAVIHGIYAGDVNKLSAKSLFPNQWRHEAKYDSLIKGVIQERAEGTMVTKREADFLQAMKVFEWDPLLKATLKDNSVFTFKDGLQMLPDRLHSRLFEDGRVEFKTGSPVESIVQSQGNSGIQVTTKGSTESKTHTHVISALSPEHLNTVCRHGSASSRLIDSIPTVTVMTVSMYFRTPDLHEPGFGYLIPQATPFENNPERALGVVFDTAYSPGSSDSRGTKVTVMLGGHWWDGWPAFPDEEEGVTMARAVLERHLGIKEAPEAWQVNLQADCIPQYTVGHETRLKKAHNNIWQEYKGRLRVAGNWMSGVGVNDCLRSAYEVARNLSKDGTGLQHVGEAPTLRMKPVRPGEKTEES

SEQ ID NO: 218 - protein, 239 aa, Apisum
KREGGIEKNQSIQIIEASDHTGGWIQSWKDENTNVISELGPRTIRGRGKSANNTYSLIKDLGIEDLVRNVGIDASARYIFANGNIHQLPMSVWKALFTVNQPFTKPWIYYVLRECFSSNNSKDKLSDVQNNDESAYDFFCRTFGQEFADYLISPLLCGVCGGNAKQMSVKFMFGALYEAERKHGTVGLGLLKEQLSSIWNREKVKDTKGTNTVKPPPSVYYLDGGLQRLIHALDIENES

SEQ ID NO: 219 - protein, 502 aa, Schizophyllum
MAPHHIAVLGGGLTGLSSAYHLSHRFPNALITLVERSTRVGGWAESERVSLKDPKDGSEASILIEGGPRTLRPTAKSVLELVTRLDLLDDLILVPRTSPSAKNKYFHMPGQPGLLAVPSSFKGLISSPLGACLTRAVAKEAMAFSNRDDLKDESFDSFLCRRFTAEFAEKVGSALVHGIFAADSRKLSVRAAFPVLWEAEEYGWGSVVRGFIRGRREEDVEESYYISNPVQKAMEETAVFSFRNGMDTVARATEHHLSKLKNVTILKGADVKSLGVNSKDKSIEVQIRPTHVVSTLPLPALHRVLTPTSNLPHLTTNPYSTVTVYNLIFRTDTPTPIHPAGFGYLIPRPPGGYEQPQANKEGILGCVFDSCALSAQDVMPGPTKYTKMTVMTGGPYQNKPPALDTVLQALARHLDWPEVYEPVYTRVRENRDCIPVPAPGHLERVAELRRVLKEGEWQGRMEVVGAGVGGVSVGDCVEAGRWVGEGWGPSTPQMEDDECDDE

SEQ ID NO: 220 - protein, 150 aa, Acinetobacter
MDAPSDAFLWVKALHIIAVVCWFAALFYLPRLYVYHAMSEDDTSHRRFEVMERKLYRGIMWPSMIATLITAHFLVDWGDATRHYHEALWFYIKVGLVGLLVIYHFVCGYYRKKLIGNAHYKSHKFWRYFNEMPTLILFAVVILVVVKPQF

SEQ ID NO: 221 - protein, 150 aa, Acinetobacter
MDAPSDAFLWVKALHIIAVVCWFAALFYLPRLYVYHAMSEDEISHRRFEIMERKLYRGIMWPSMIATLITAHFLVDWGDATRHYHEALWFYIKVGLVGLLVIYHFVCGYYRKKLIGNAHYKSHKFWRYFNEMPTLILFAVVILVVVKPQF

SEQ ID NO: 222 - protein, 150 aa, Acinetobacter
MDAPSDAFLWVKALHIIAVVCWFAALFYLPRLYVYHAMSEDEISHRRFEIMERKLYRGIMWPSMIATLITAHFLVDWGDATRHYHQALWFYIKVGLVGLLVIYHFVCGYYRKKLIGNAHYKSHKFWRYFNEMPTLILFAVVILVVVKPQF

SEQ ID NO: 223 - protein, 150 aa, Acinetobacter
MDAPSDAFLWVKALHIIAVVCWFAALFYLPRLYVYHAMSEDTVSHQRFEVMERKLYRGIMWPSMIATLITAHFLVDWGDATRHYHEALWFYLKVGLVGLLVIYHFVCGYYRKKLIGNAHYKSHKFWRFFNEMPTLILFAVVILVVVKPQF

SEQ ID NO: 224 - protein, 150 aa, Acinetobacter
MDAPSDAFLWVKALHIIAVVCWFAALFYLPRLYVYHAMSEDAVSHQRFEVMERKLYRGIMWPSMIATLITAHFLVDWGDATRHYHEALWFYLKVGLVGLLVIYHFVCGYYRKKLIGNAHYKSHKFWRFFNEMPTLILFAVVILVVVKPQF

SEQ ID NO: 225 - protein, 150 aa, Acinetobacter
MDAPSDAFLWVKALHIIAVVCWFAALFYLPRLYVYHAMSEDAVSHQRFEVMERKLYRGIMWPSMIATLITAHFLVDWGDATRHYHEALWFYLKVGMVGLLVIYHFVCGYYRKKLIGNAHYKSHKFWRFFNEMPTLILFAVVILVVVKPQF

SEQ ID NO: 226 - protein, 150 aa, Acinetobacter
MDAPSDAFLWVKALHIIAVVCWFAALFYLPRLYVYHAMSEDVVSHQRFEVMERKLYRGIMWPSMIATLITAHFLVDWGDATRHYHEALWFYLKVGLVGLLVIYHFVCGYYRKKLIGNAHYKSHKFWRFFNEMPTLILFAVVILVVVKPQF

SEQ ID NO: 227 - protein, 150 aa, Acinetobacter
MDAPSDAFLWVKALHIIAVVCWFAALFYLPRLFVYHAMSEDTVSHQRFEVMERKLYRGIMWPSMIATLITAHFLVDWGDATRHYHEALWFYLKVGLVGLLVIYHFVCGYYRKKLIGNAHYKSHKFWRFFNEMPTLILFAVVILVVVKPQF

SEQ ID NO: 228 - protein, 150 aa, Acinetobacter
MDAPSDAFLWVKALHIIAVVCWFAALFYLPRLYVYHAMSEDAVSHQRFEVMERKLYRGIMWPSMIATLITAHFLVDWGDASRHYHEALWFYLKVGLVGLLVIYHFVCGYYRKKLIGNAHYKSHKFWRFFNEMPTLILFAVVILVVVKPQF

SEQ ID NO: 229 - protein, 150 aa, Acinetobacter
MDAPSDAFLWVKALHIIAVVCWFAALFYLPRLFVYHAMSEDAVSHQRFEVMERKLYRGIMWPSMIATLITAHFLVDWGDATRHYHEALWFYLKVGLVGLLVIYHFVCGYYRKKLIGNAHYKSHKFWRFFNEMPTLILFAVVILVVVKPQF

SEQ ID NO: 230 - protein, 150 aa, Acinetobacter
MDAPSDAFLWVKALHIIAVVCWFAALFYLPRLFVYHAMSEDAVSHQRFEVMERKLYRGIMWPSMIATLITAHFLVDWGDATRHYHEALWFYLKVGLVGLLVIYHFICGYYRKKLIGNAHYKSHKFWRFFNEMPTLILFAVVILVVVKPQF

SEQ ID NO: 231 - protein, 150 aa, Acinetobacter
MDAPSDAFLWVKALHIIAVVCWFAALFYLPRLYVYHAMSEDAVSHQRFEVMERKLYRGIMWPSMIATLITAHFLVDWGDATRHYHEALWFYLKVGLVGLLVIYHLVCGYYRKKLIGNAHYKSHKFWRFFNEMPTLILFAVVILVVVKPQF

SEQ ID NO: 232 - protein, 150 aa, Acinetobacter
MDAPSDAFLWVKALHIIAVVCWFAALFYLPRLFVYHAMSEDAVSHQRFEVMERKLYRGIMWPSMIATLITAHFLVDWGDASRHYHEALWFYLKVGLVGLLVIYHFVCGYYRKKLIGNAHYKSHKFWRFFNEMPTLILFAVVILVVVKPQF

SEQ ID NO: 233 - protein, 150 aa, Acinetobacter
MDAPSDAFLWVKALHIIAVVCWFAALFYLPRLYVYHAMSEDAVSHQRFEVMERKLYRGIMWPSMIATLITAHFLVDWGDATRHYHEALWFYLKVGLVGLLVIYHLVCGYYRKKLIGNAHYKTHKFWRFFNEMPTLILFAVVILVVVKPQF

SEQ ID NO: 234 - protein, 150 aa, Acinetobacter
MDAPSDAFLWVKALHIIAVVCWFAALFYLPRLFVYHAMSEDALSHQRFEVMERKLYRGIMWPSMIATLITAHFLVDWGDATRHYHDALWFYLKVGLVGLLVIYHFVCGYYRKKLIGNAHYKSHKFWRFFNEMPTLILFAVVILVVVKPQF

SEQ ID NO: 235 - protein, 150 aa, Acinetobacter
MDAPSDAFLWVKALHIIAVVCWFAALFYLPRLYVYHAMSEDAISHQRFEVMERKLYRGIMWPSMIATLITAHFLVDWGDATRHYHEALWFYLKVGLVGLLVIYHLVCGYYRKKLIGNAHYKTHKFWRFFNEMPTLILFAVVILVVVKPQF

SEQ ID NO: 236 - protein, 150 aa, Acinetobacter
MDAPSDAFLWVKALHIIAVVCWFAALFYLPRLYVYHAMSEDKVSHQRFEVMERKLYRGIMWPSMLATLITAHFLVDWGDATRHYHEALWFYLKVGLVGLLVIYHFVCGYYRKKLISNAHYKSHQFWRFFNEMPTLILFAVVILVVVKPQF

SEQ ID NO: 237 - protein, 150 aa, Acinetobacter
MDAPSDAFLWVKALHIIAVVCWFAALFYLPRLYVYHAMSEDEISHQRFEVMERKLYRGIMWPSMIATLVTAHFLVEWGDATRHYHEAIWFYLKVGLVGLLVIYHFVCGYYRKKLIGNAHYKSHKFWRFFNEMPTLLLFAIIILVVVKPQF

SEQ ID NO: 238 - protein, 150 aa, Acinetobacter
MDAPSDAFLWVKALHIIAVVCWFAALFYLPRLYVYHAMSEDAISHQRFEVMERKLYRGIMWPSMIATLVTAHFLVEWGDATRHYHEALWFYLKVGLVGLLVIYHFVCGYYRKKLIGNAHYKSHKFWRFFNEMPTLLLFAIIILVVVKPQF

SEQ ID NO: 239 - protein, 150 aa, Acinetobacter
MDAPSDAFLWVKALHIIAVVCWFAALFYLPRLYVYHAMSDDAVSHQRFEVMERKLYRGIMWPSMIATLITAHFLVDWGDATRHYHEALWFYLKVGLVGLLVIYHFVCGYYRKKLIGNAHYKSHKFWRFFNEMPTLILFAVVILVVVKPTF

SEQ ID NO: 240 - protein, 150 aa, Acinetobacter
MDAPSDAFLWVKALHIIAVVCWFAALFYLPRLYVYHAMSEDAISHQRFEVMERKLYRGIMWPSMIATLLTAHFLVDWGDATRHYHEALWFYMKVGLVGLLVIYHFVCGYYRKKLIGNAHYKSHRFWRFFNEMPTLLLFAIIILVVVKPQF

SEQ ID NO: 241 - protein, 150 aa, Acinetobacter
MDAPSDAFLWVKALHIIAVVCWFAALFYLPRLYVYHAMSEDAVSHQRFEVMERKLYRGIMWPSMIATLITAHFLVDWGDATRHYHDALWFYLKVGLVGLLVIYHFVCGYYRKKLIGHAHYKSHKFWRFFNEMPTLILFAVVILVVVKPQF

SEQ ID NO: 242 - protein, 150 aa, Acinetobacter
MDAPSEAFLWVKALHIIAVVCWFAALFYLPRLYVYHAMSEDTVSHQRFEIMERKLYRGIMWPSMIATLITAHFLVDWGDATRHYHEALWFYLKVGLVGLLVIYHFVCGYYRKKLIGNAHYKSHKFWRFFNEMPTLILFAVIILVVVKPTF

SEQ ID NO: 243 - protein, 150 aa, Acinetobacter
MDAPSDAFLWVKALHIIAVVCWFAALFYLPRLYVYHAMSEDAISHQRFEVMERKLYRGIMWPSMIATLVTAHFLVEWGDATRHYHEAIWFYLKVGLVGLLVIYHFVCGYYRKKLIGNAHYKSHKFWRFFNEMPTLLLFAIIILVVVKPQF

SEQ ID NO: 244 - protein, 150 aa, Acinetobacter
MDAPSDAFLWVKALHIIAVVCWFAALFYLPRLYVYHAMSDDATSHQRFEVMERKLYRGIMWPSMIATLITAHFLVDWGDATRHYHEATWFYLKVGLVALLVIYHLVCGYYRKKLIGNAHYKSHKFWRFFNEMPTLILFAVVILVVVKPQF

SEQ ID NO: 245 - protein, 150 aa, Acinetobacter
MDAPSDAFLWVKALHIIAVVCWFAALFYLPRLYVYHAMSEDAVSHQRFEVMERKLYRGIMWPSMIATLVTAHFLVDWGDATRHYHDALWFYLKVGLVGLLVIYHLVCGYYRKKLIGNAHYKSHRFWRFFNEMPTLILFAVVILVVVKPQF

SEQ ID NO: 246 - protein, 150 aa, Acinetobacter
MDAPSDAFLWVKALHIIAVVCWFAALFYLPRLYVYHAMSEDAVSHQRFEVMERKLYRGIMWPAMLATLITAHFLVDWGDATRHYHEALWFYLKVGLVGLLVIYHLVCGYYRKKLIGNAHYKSHKFWRYFNEMPTLILFAVVILVVVKPTF

SEQ ID NO: 247 - protein, 150 aa, Acinetobacter
MDAPSDAFLWVKALHIIAVVCWFAALFYLPRLFVYHAMSEDALSHQRFEVMERKLYRGIMWPSMIATLITAHFLVDWGDATRHYHDALWFYLKVGLVGLLVIYHLVCGYYRKKLIGNAHYKSHKFWRFFNEMPTLILFAVVILVVVKPQF

SEQ ID NO: 248 - protein, 150 aa, Acinetobacter
MDAPSDAFLWVKALHIIAVVCWFAALFYLPRLYVYHAMSEDAASHQRFEVMERKLYRGIMWPSMIATLITAHFLVDWGDATRHYHEATWFYLKVGLVALLVIYHLVCGYYRKKLIGNAHYKSHKFWRFFNEMPTLILFAVVILVVVKPQF

SEQ ID NO: 249 - protein, 150 aa, Acinetobacter
MDAPSDAFLWVKALHIIAVVCWFAALFYLPRLYVYHAMSEDEISHQRFEVMERKLYRGIMWPSMIATLVTAHLLVEWGDATRHYHEAIWFYLKVGLVGLLVIYHFVCGYYRKKLIGNAHYKSHKFWRFFNEMPTLLLFAIIILVVVKPQF

SEQ ID NO: 250 - protein, 150 aa, Acinetobacter
MDAPSDAFLWVKALHIIAVVCWFAALFYLPRLYVYHAMSDDATSHQRFEVMERKLYRGIMWPSMIATLITAHFLVEWGDATRHYHEATWFYLKIGLVALLVVYHFVCGYYRKKLIGNAHYKSHKFWRFFNEMPTLILFAVVILVVVKPQF

SEQ ID NO: 251 - protein, 150 aa, Unknown
  Bacteria
MDAPSDAFLWVKALHIIAVVCWFAALFYLPRLYVYHAMSDDAVSHQRFEVMERKLYRGIMWPAMIATLITAHFLVDWGDATRHYHEALWFYLKVGLVGLLVIYHFVCGYYRKKLIGNAHYKSHKFWRFFNEMPTLILFAVVILVVVKPTF

SEQ ID NO: 252 - protein, 150 aa, Acinetobacter
MDAPSDAFLWVKALHIIAVVCWFAALFYLPRLYVYHAMSEDAISHQRFEVMERKLYRGIMWPAMLATLITAHFLVDWGDATRHYHEALWFYLKVGLVGLLVIYHLVCGYYRKKLIGNAHYKSHKFWRYFNEMPTLILFAVVILVVVKPTF

SEQ ID NO: 253 - protein, 150 aa, Acinetobacter
MDAPSDAFLWVKALHIIAVVCWFAALFYLPRLYVYHAMSDDATSHQRFEIMERKLYRGIMWPSMIATLITAHFLVDWGDATRHYHEATWFYLKVGLVALLVIYHLVCGYYRKKLIGNAHYKSHKFWRFFNEMPTLILFAVVILVVVKPQF

SEQ ID NO: 254 - protein, 150 aa, Acinetobacter
MDAPSDAFLWVKALHIIAVVCWFAALFYLPRLYVYHAMSEDAVSHQRFEVMERKLYRGIMWPSMIATLVTAHFLVDWGDATRHYHEALWFYLKVALVGLLVIYHLVCGYYRKKLIGNAHYKSHKFWRFFNEMPTVILFAVVILVVVKPQF

SEQ ID NO: 255 - protein, 150 aa, Acinetobacter
MDAPSDAFLWVKALHIIAVVCWFAALFYLPRLYVYHAMSDDTVSHQRFEVMERKLYRGIMWPSMVATLITAHFLVDWGDATRHYHEALWFYIKVALVGLLVIYHFVCGYYRKKLIGNAHYKSHKFWRFFNEMPTLILFAVVILVVVKPHF

SEQ ID NO: 256 - protein, 150 aa, Acinetobacter
MDAPSDAFLWVKALHIIAVVCWFAALFYLPRLYVYHAMSEDAASHQRFEVMERKLYRGIMWPSMIATLITAHFLVDWGDATRHYHQATWFYLKVGLVALLVIYHLVCGYYRKKLIGNAHYKSHKFWRFFNEMPTLILFAVVILVVVKPQF

SEQ ID NO: 257 - protein, 150 aa, Acinetobacter
MDAPSEAFLWVKALHIIAVVCWFAALFYLPRLFVYHAMSDDNLSHQRFEIMERKLYRGIMWPSMIATLITAHFLVDWGDATRHYHEALWFYLKVGLVGLLVIYHFVCGYYRKKLIGNAHYKSHKFWRFFNEMPTLILFAVVILVVVKPTF

SEQ ID NO: 258 - protein, 150 aa, Acinetobacter
MDAPSDAFLWVKALHIIAVVCWFAALFYLPRLYVYHAMSDDATSHHRFEVMERKLYRGIMWPSMIATLITAHFLVDWGDATRHYHEATWFYLKVGLVALLVIYHLVCGYYRKKLIGNAHYKSHKFWRFFNEMPTLILFAVVILVVVKPQF

SEQ ID NO: 259 - protein, 150 aa, Acinetobacter
MDAPSDAFLWVKALHIIAVVCWFAALFYLPRLYVYHAMSDDATSHQRFEVMERKLYRGIMWPSMIATLITAHFLVEWGDATRHYHEATWFYLKVGLVALLVIYHLVCGYYRKKLIGNAHYKSHKFWRFFNEMPTLILFAVVILVVVKPQF

SEQ ID NO: 260 - protein, 150 aa, Acinetobacter
MDAPSNAFLWVKALHIIAVVCWFAALFYLPRLYVYHAMSDDATSHQRFEVMERKLYRGIMWPSMIATLITAHFLVDWGDATRHYHEATWFYLKVGLVALLVIYHLVCGYYRKKLIGNAHYKSHKFWRFFNEMPTLILFAVVILVVVKPQF

SEQ ID NO: 261 - protein, 150 aa, Acinetobacter
MDAPSDAFLWVKALHIIAVVCWFAALFYLPRLYVYHAMSEDVISHQRFEVMERKLYRGIMWPSMIATLLTAHFLVDWGDATRHYHEALWFYLKVSLVGLLVIYHFVCGYYRKKLIGNAHYKSHRFWRFFNEMPTLLLFAIIILVVVKPQF

SEQ ID NO: 262 - protein, 150 aa, Acinetobacter
MDAPSDAFLWVKALHIIAVVCWFAALFYLPRLYVYHAMSDDATSHQRFEVMERKLYRGIMWPSMIATLITAHFLVDWGDATRHYHEATWFYLKVGLVALLVIYHLVCGYYRKKLIGNAHYKSHKFWRFFNEMPTFILFAVVILVVVKPQF

SEQ ID NO: 263 - protein, 150 aa, Acinetobacter
MDAPSDAFLWVKALHIIAVVCWLAALFYLPRLYVYHAMSDDATSHQRFEVMERKLYRGIMWPSMIATLITAHFLVDWGDATRHYHEATWFYLKVGLVALLVIYHLVCGYYRKKLIGNAHYKSHKFWRFFNEMPTLILFAVVILVVVKPQF

SEQ ID NO: 264 - protein, 150 aa, Acinetobacter
MDAPSDAFLWVKALHIIAVVCWFAALFYLPRLYVYHAMSDDAVSHQRFEVMERKLYRGIMWPSMIATLITAHFLVDWGDATRHYHEALWFYLKVGLVGLLVIYHFVCGYYRKKLIGHAHYKSHKFWRFFNEMPTLILFAVVILVVVKPTF

SEQ ID NO: 265 - protein, 150 aa, Acinetobacter
MDAPSDAFLWVKALHIIAVVCWFAALFYLPRLYVYNAMSDDATSHQRFEVMERKLYRGIMWPSMIATLITAHFLVDWGDATRHYHEATWFYLKVGLVALLVIYHLVCGYYRKKLIGNAHYKSHKFWRFFNEMPTLILFAVVILVVVKPQF

SEQ ID NO: 266 - protein, 150 aa, Acinetobacter
MDAPSDAFLWVKALHIIAVVCWFAALFYLPRLYVYHAMSDDAASHQRFEVMERKLYRGIMWPSMIATLITAHFLVDWGDATRHYHEATWFYLKVGLVALLVIYHLVCGYYRKKLIGNAHYKSHKFWRFFNEMPTLILFAVVILVVVKPQF

SEQ ID NO: 267 - protein, 150 aa, Acinetobacter
MDAPSDAFLWVKALHIIAVVCWFAALFYLPRLYVYHAMSDDAASHQRFEVMERKLYRGIMWPSMIATLITAHFLVEWGDATRHYHEATWFYLKVGLVALLVVYHFVCGYYRKKLIGNAHYKSHKFWRFFNEMPTLILFAVVILVVVKPQF

SEQ ID NO: 268 - protein, 150 aa, Acinetobacter
MDAPSDAFLWVKALHIIAVVCWFAALFYLPRLYVYHAMSEDAASHQRFEVMERKLYRGIMWPSMIATLITAHFLVEWGDATRHYHEATWFYLKVGLVALLVVYHLVCGYYRKKLIGNAHYKSHKFWRFFNEMPTLILFAVVILVVVKPQF

SEQ ID NO: 269 - protein, 150 aa, Acinetobacter
MDAPSDAFLWVKALHIIAVVCWFAALFYLPRLYVYHAMSEDAVSHQRFEVMERKLYRGIMWPAMLATLITAHFLVDWGDATRHYHEALWFYLKVGLVGLLVIYHLVCGYYRKKLINNAHYKSHKFWRYFNEMPTLILFAVVILVVVKPTF

SEQ ID NO: 270 - protein, 150 aa, Acinetobacter
MDAPSDAFLWVKALHIIAVVCWFAALFYLPRLYVYHAMSEDAASHQRFEVMERKLYRGIMWPSMIATLITAHFLVEWGDATRHYHQATWFYLKVGLVALLVIYHLVCGYYRKKLIGNAHYKSHKFWRFFNEMPTLILFAVVILVVVKPQF

SEQ ID NO: 271 - protein, 150 aa, Acinetobacter
MDAPSDAFLWVKALHIIAVVCWFAALFYLQRLYVYHAMSDDATSHQRFEVMERKLYRGIMWPSMIATLITAHFLVDWGDATRHYHEATWFYLKVGLVALLVIYHLVCGYYRKKLIGNAHYKSHKFWRFFNEMPTLILFAVVILVVVKPQF

SEQ ID NO: 272 - protein, 150 aa, Acinetobacter
MDAPSEAFLWVKALHIIAVVCWFAALFYLPRLFVYHAMSDDNLSHQRFEIMERKLYRGIMWPSMIATLITAHFLVDWGDATRHYHEALWFYLKVGLVGLLVIYHFACGYYRKKLIGNAHYKSHKFWRFFNEMPTLILFAVVILVVVKPTF

SEQ ID NO: 273 - protein, 150 aa, Acinetobacter
MDAPSDAFLWVKALHIIAVVCWFAALFYLPRLYVYHAMSEDTASHQRFEVMERKLYRGIMWPSMIATLITAHFLVDWGDATRHYHQATWFYLKVGLVALLVIYHLACGYYRKKLIGNAHYKSHKFWRFFNEMPTLILFAVIILVVVKPQF

SEQ ID NO: 274 - protein, 150 aa, Acinetobacter
MDAPSDAFLWVKALHIIAVVCWFAALFYLPRLYVYHAMSEDAVSHQRFEVMERKLYRGIMWPSLIATLITAHFLVDWGDATRHYHQATWFYLKVGLVALLVIYHLVCGYYRKKLIGNAHYKSHKFWRFFNEMPTLILFAVVILVVVKPQF

SEQ ID NO: 275 - protein, 150 aa, Acinetobacter
MDAPSDAFLWVKALHIIAVVCWFAALFYLPRLYVYHAMSKDAASHQRFEVMERKLYRGIMWPSMIATLITAHFLVDWGDATRHYHQATWFYLKVGLVALLVIYHLVCGYYRKKLIGNAHYKSHKFWRFFNEMPTLILFAVVILVVVKPQF

SEQ ID NO: 276 - protein, 150 aa, Acinetobacter
MDAPSDAFLWVKALHIIAVVCWFAALFYLPRLYVYHAMSEDAVSHQRFEVMERKLYRGIMWPAMLATLITAHFLVDWGDATRHYHEALWFYLKVGLVGLLVIYHLVCGYYRKKLIDNAHYKSHKFWRYFNEMPTLILFAVVILVVVKPTF

SEQ ID NO: 277 - protein, 150 aa, Acinetobacter
MDAPSDAFLWVKALHIIAVVCWFAALFYLPRLYVYHAMSEDAASHQRFEVMERKLYRGIMWPSMIATLITAHFLVEWGDATRHYHQATWFYLKVGLVTLLVIYHLVCGYYRKKLIGNAHYKSHKFWRFFNEMPTLILFAVVILVVVKPQF

SEQ ID NO: 278 - protein, 150 aa, Acinetobacter
MDAPTDAFLWVKALHIIAVVCWFAALFYLPRLYVYHAMSEDTISHQRFEVMERKLYRGIMWPSMIATLITAHFLVDWGDATQHYHQAVWFYLKVALVALLVIYHFVCGYYRKKLIGNAHYKSHKFWRFFNEMPTLILFAVVILVVVKPQF

SEQ ID NO: 279 - protein, 150 aa, Acinetobacter
MDAPSDAFLWVKALHIIAVVCWFAALFYLPRLYVYHAMSDDATSHQRFEVMERKLYRGIMWPSMIATLITAHFLVEWGDATRHYHEATWFYLKVGLVALLVIYNLVCGYYRKKLIGNAHYKSHKFWRFFNEMPTLILFAVVILVVVKPQF

SEQ ID NO: 280 - protein, 150 aa, Acinetobacter
MDAPSDAFLWVKALHIIAVVCWFAALFYLPRLYVYHAMSDDAVSHQRFEVMERKLYRGIMWPSMIATLITAHFLVEWGDATRHYHEALWFYLKVGLVGLLVIYHFVCGYYRKKLIGHAHYKSHKFWRFFNEMPTLILFAVVILVVVKPTF

SEQ ID NO: 281 - protein, 150 aa, Acinetobacter
MDAPSDAFLWVKALHIIAVVCWFAALFYLPRLYVYHAMSEDAASHQRFEVMERKLYRGIMWPSMIATLITAHFLVEWGDATRHYHDATWFYLKVGLVALLVIYHLVCGYYRKKLIGNAHYKSHKFWRFFNEMPTLILFAVVILVVVKPQF

SEQ ID NO: 282 - protein, 150 aa, Acinetobacter
MDAPSDAFLWVKALHIIAVVCWFAALFYLPRLYVYHAMSDDAASHQRFEVMERKLYRGIMWPSMIATLITAHFLVEWGDATRHYHEATWFYLKVGLVALLVIYHLVCGYYRKKLIGNAHYKSHKFWRFFNEMPTLILFAVVILVVVKPQF

SEQ ID NO: 283 - protein, 150 aa, Acinetobacter
MDVPSDAFLWVKALHIIAVVCWFAALFYLPRLYVYHAMSDDATSHQRFEVMERKLYRGIMWPSMIATLITAHFLVEWGDATRHYHEATWFYLKVGLVALLVIYHLVCGYYRKKLIGNAHYKSHKFWRFFNEMPTLILFAVVILVVVKPQF

SEQ ID NO: 284 - protein, 150 aa, Acinetobacter
MDAPSDAFLWVKALHIIAVVCWFAALFYLPRLYVYHAMSEDTVSHQRFEVMERKLYRGIMWPAMLATLITAHFLVDWGDATRHYHEALWFYLKVGLVGLLVIYHLVCGYYRKKLIDNAHYKSHKFWRYFNEMPTLLLFAVVILVVVKPTF

SEQ ID NO: 285 - protein, 150 aa, Acinetobacter
MDAPSDAFLWVKALHIIAVVCWFAALFYLPRLYVYHAMSEDAASHQRFEVMERKLYRGIMWPSMIATLITAHFLVEWGDATRHYHQATWFYLKVGLVALLMIYHLVCGYYRKKLIGNAHYKSHKFWRFFNEMPTLILFAVVILVVVKPQF

SEQ ID NO: 286 - protein, 150 aa, Acinetobacter
MDAPSDAFLWVKALHIIAVVCWFAALFYLPRLYVYHAMSEDAVSHQRFEVMERKLYRGIMWPAMLATLITAHFLVDWGDATRHYHEALWFYLKVGLVGLLVIYHLVCGYYRKKLIDNAHYKSHKFWRYFNEMPTLLLFAVVILVVVKPTF

SEQ ID NO: 287 - protein, 150 aa, Acinetobacter
MDAPSDAFLWVKALHIIAVVCWFAALFYLPRLYVYHAMSEDAVSHQRFEVMERKLYRGIMWPSLIATLITAHFLVDWGDATRHYHQATWFYLKVGLVALLVIYHLACGYYRKKLIGNAHYKSHKFWRFFNEMPTLILFAVVILVVVKPQF

SEQ ID NO: 288 - protein, 150 aa, Acinetobacter
MDAPSDAFLWVKALHIIAVVCWFAALFYLPRLYVYHAMSEDAASHQRFEIMERKLYRGIMWPSMIATLITAHFLVEWGDATRHYHQATWFYLKVGLVALLVIYHLVCGYYRKKLIGNAHYKSHRFWRFFNEMPTLILFAVVILVVVKPQF

SEQ ID NO: 289 - protein, 150 aa, Acinetobacter
MDAPSDAFLWVKALHIIAVVCWFAALFYLPRLYVYHAMSEDAVSHQRFEVMERKLYRGIMWPAMLATLITAHFLVDWGDATRHYHEALWFYLKVGLVGLLVIYHLICGYYRKKLINNAHYKSHKFWRYFNEMPTLILFAVVILVVVKPTL

SEQ ID NO: 290 - protein, 150 aa, Acinetobacter
MDAPSDAFLWVKALHIIAVVCWFAALFYLPRLYVYHAMSDDAISHQRFEVMERKLYRGIMWPAMIATLITAHFLVDWGDATRHYHEALWFYLKVGLVGLLVIYHLMCGYYRKKLIDNAHYKSHKFWRYFNEMPTLILFAVVILVVVKPTF

SEQ ID NO: 291 - protein, 150 aa, Acinetobacter
MDAPSDAFLWVKALHIIAVVCWFAALFYLPRLYVYHAMSEDAASHQRFEIMERKLYRGIMWPSMIATLITAHFLVEWGDATRHYHQATWFYLKVALVALLVIYHLVCGYYRKKLIGNAHYKSHKFWRFFNEMPTLILFAVVILVVVKPQF

SEQ ID NO: 292 - protein, 150 aa, Acinetobacter
MDAPSDAFLWVKALHIIAVVCWFAALFYLPRLYVYHAMSDDAVSHQRFEVMERKLYRGIMWPSMIATLITAHFLVDWGDATRHYHEALWFYLKVGLVGLLVIYHFVCGYYRKKLIRHAHYKSHKFWRFFNEMPTLILFAVVILVVVKPTF

SEQ ID NO: 293 - protein, 150 aa, Acinetobacter
MDAPSDAFLWVKALHIIAVVCWFAALFYLPRLYVYHAMSEDTVSHERFQVMERKLYRGIMWPAMVATLITAHFLVDWGDATRHYHEALWFYLKVGLVGLLVIYHLVCGYYRKKLIENAHYKSHKFWRFFNEMPTLILFAVVILVVVKPTF

SEQ ID NO: 294 - protein, 150 aa, Acinetobacter
MDAPSDAFLWVKALHIIAVVCWFAALFYLPRLYVYHAMSEDAASHQRFEVMERKLYRGIMWPSMIATLITAHFLVEWGDATRHYHQATWFYLKVALVALLVIYHLVCGYYRKKLIGNAHYKSHRFWRFFNEMPTLILFAVVILVVVKPQF

SEQ ID NO: 295 - protein, 150 aa, Acinetobacter
MDAPSDAFLWVKALHIIAVVCWFAALFYLPRLYVYHAMSEDAVSHQRFEVMERKLYRGIMWPSLIATLITAHFLVDWGDATRHYHQATWFYLKVALVALLVIYHLACGYYRKKLIGNAHYKSHKFWRFFNEMPTLILFAVVILVVVKPQF

SEQ ID NO: 296 - protein, 150 aa, Acinetobacter
MDAPSDAFLWVKALHIIAVVCWFAALFYLPRLYVYHAMSEDAVSHQRFEVMERKLYRGIMWPAMLATLITAHFLVDWGDATRHYHEALWFYLKVGLVGLLVIYHLVCGHYRKKLMENAHYKSHKFWRYFNEMPTLILFAVVILVVVKPTF

SEQ ID NO: 297 - protein, 150 aa, Acinetobacter
MDAPSDAFLWVKALHIIAVVCWFAALFYLPRLYVYHAMSEDVVSHQRFEIMERKLYRGIMWPAMVATLITAHFLVDWGDATRHYHEALWFYLKVGLVGLLVIYHLVCGYYRKKLMENAHYKSHKFWRFFNEMPTLILFAVVILVVVKPTF

SEQ ID NO: 298 - protein, 150 aa, Acinetobacter
MDAPSDAFLWVKALHIIAVVCWFAALFYLPRLYVYHAMSEDAASHQRFEVMERKLYRGIMWPSMIATLITAHFLVEWGDATRHYHQATWFYLKVALVALLIIYHLVCGYYRKKLIGNAHYKSHRFWRFFNEMPTLILFAVVILVVVKPQF

SEQ ID NO: 299 - protein, 150 aa, Acinetobacter
MDAPSDAFLWVKALHIIAVVCWFAALFYLPRLYVYHAMSEDAASHQRFEIMERKLYRGIMWPSMIATLITAHFLVEWGDATRHYHQATWFYLKVALVALLVIYHLVCGYYRKKLIGNAHYKSHRFWRFFNEMPTLILFAVVILVVVKPQF

SEQ ID NO: 300 - protein, 150 aa, Acinetobacter
MDAPTDAFLWVKALHIIAVVCWFAALFYLPRLYVYHAMSEDTISHQRFEVMERKLYRGIMWPSMIATLITAHFLVDWGDGTQHYHQAGWFYLKVALVALLVIYHFVCGYYRKKLIGNAHYKSHKFWRFFNEMPTLILFAVVILVVVKPQF

SEQ ID NO: 301 - protein, 150 aa, Acinetobacter
MDAPSDAFLWVKALHIIAVVCWFAALFYLPRLYVYHAMSEDAASHQRFEIMERKLYRGIMWPSLIATLITAHFLVDWGDATRHYHQATWFYLKVALVALLVIYHLACGYYRKKLIGNAHYKSHKFWRFFNEMPTLILFAVVILVVVKPQF

SEQ ID NO: 302 - protein, 150 aa, Acinetobacter
MDAPSDAFLWVKALHIIAVVCWFAALFYLPRLYVYHAMSEDVVSHQRFEIMERKLYRGIMWPAMVATLITAHFLVDWGDATRHYHEALWFYLKVGLVGLLVIYHLICGYYRKKLMENAHYKSHKFWRFFNEMPTLILFAVVILVVVKPTF

SEQ ID NO: 303 - protein, 150 aa, Acinetobacter
MDAPSDAFLWVKALHIIAVVCWFAALFYLPRLYVYHAMSEDAASHQRFEVMERKLYRGIMWPSMIATLITAHFLVEWGDATRHYHQATWFYLKVALVALLVIYHLVCGYYRKKLIGNAHYKSHRFWRFFNEMPTVILFAVVILVVVKPQF

SEQ ID NO: 304 - protein, 150 aa, Acinetobacter
MDAPSDAFLWVKALHIIAVVCWFAALFYLPRLYVYHAMSEDTLSHQRFEIMERKLYRGIMWPSMIATLITAHFLVDWGDATRNYHDALWFYLKVALVGLLVIYHLVCGYYRQKLIGNAHYKSHKFWRFFNEMPTVLLLAIVILVVVKPQF

SEQ ID NO: 305 - protein, 150 aa, Acinetobacter
MDAPSDAFLWVKALHIIAVVCWFAALFYLPRLYVYHAMSEDAVSHARFQVMERKLYRGIMWPAMLATLITAHFLVDWGDATRHYHEAVWFYLKVGLVGLLVIYHLVCGHYRKKLMENAHYKSHKFWRYFNEMPTLILFAVVILVVVKPTF

SEQ ID NO: 306 - protein, 150 aa, Acinetobacter
MDAPSDAFLWVKALHIIAVVCWFAALFYLPRLYVYHAMSEDAVSHQRFEVMERKLYRGIMWPSMIATLITAHFLVDWGDATRNYHDALWFYLKVALVGLLVIYHLVCGYYRLKLIGNAHYKSHKFWRFFNEMPTVLLFAIVILVVVKPVF

SEQ ID NO: 307 - protein, 150 aa, Acinetobacter
MDAPSDAFLWVKALHIIAVVCWFAALFYLPRLYVYHAMSEDAVSHQRFEVMERKLYRGIMWPSMIATLITAHFLVDWGDATRHYHEALWFYLKVGLVGLLVIYHLVCGYYRKKLIGNAHYKTHKFWRFFNEMPTLILFAVVVLVVVKPQF

SEQ ID NO: 308 - protein, 150 aa, Acinetobacter
MDAPSSAFLWVKALHIIAVVCWFAALFYLPRLYVYHAMSKDQASYERFQIMERKLYRGIMWPAMIATLITAHFLVDWGDATRHYHEALWFYFKVGLVGLLIIYHFVCGYYRKKLIDNAHYKTHKFWRMFNELPTVILFAVVILVVVKPQF

SEQ ID NO: 309 - protein, 149 aa, Acinetobacter
MNAPSDAFFWIKALHIIAVVCWFAALFYLPRLYVYHAMSDDTVSHQRFEVMERKLYRGIMWPAMIATLITAHFLVDWGDQFYHYHEALWFYLKVALVGLLVIYHFVCGYYRKKLIGNAHYKTHKFWRFFNEMPTLLLFAIVILVVVKPF

SEQ ID NO: 310 - protein, 150 aa, Acinetobacter
MDAPSDAFLWVKALHIIAVVCWFAALFYLPRLYVYHAMSEDTVSHQRFEVMERKLYRGIMWPSMIATLITAHFLVDWGDATRHYHEALWFYLKVGLVGLLVIYHFVCGYYRKKLIGNAHYKSHKFWRFFNEMPTLILLAVVILVVVKPQF

SEQ ID NO: 311 - protein, 142 aa, Acinetobacter
MWVKALHIIAVVCWFAALFYLPRLYVYHAMSDDATSHQRFEVMERKLYRGIMWPSMIATLITAHFLVDWGDATRHYHEATWFYLKVGLVALLVIYHLVCGYYRKKLIGNAHYKSHKFWRFFNEMPTLILFAVVILVVVKPQF

SEQ ID NO: 312 - protein, 150 aa, Acinetobacter
MDAPSDAFLWVKALHIIAVVCWFAALFYLPRLYVYHAMSDDAVSHQRFEVMERKLYRGIMWPSMIATLITAHFLVDWGDATRHYHEALWFYLKVGLVGLLVIYHFVCGYYRKKLIGNAHYKSHKFWRFFNEMPTLILVAVIILVVVKPQF

SEQ ID NO: 313 - protein, 150 aa, Acinetobacter
MDAPSDAFLWVKALHIIAVVCWFAALFYLPRLYVYHAMSEDAVSHQRFEVMERKLYRGIMWPSMIATLVTAHFLVDWGDATRHYHEALWFYLKVALVGLLVIYHLVCGYYRKKLIGNAHYKSHKFWRFFNEMPTVILLAVVILVVVKPQF

SEQ ID NO: 314 - protein, 150 aa, Acinetobacter
MDAPSDAFLWVKALHIIAVVCWFAALFYLPRLYVYHAMSEDGTSHQRFQIMERKLYRGIMWPSMLATLITAHFLVDWGDATRHYHEALWFYLKVGLVGLLVIYHFVCGYYRKKLMENPHYKSHKFWRFFNEMPTLILLAVVILVVVKPQF

SEQ ID NO: 315 - protein, 150 aa, Acinetobacter
MNAPSEAFLWVKALHIIAVVCWFAALFYLPRLYVYHAMSDDDASHQRFEVMERKLYRGIMWPAMIATLITAHFLVDWGDATYHYHEALWFYLKVGLVGLLVIYHFVCGYYRKKLIGNAHYKSHKFWRVFNEMPTLILLAVVILVVVKPTF

SEQ ID NO: 316 - protein, 148 aa, Acinetobacter
MVSEAFLWVKALHIIAVVCWFAALFYLPRLYVYHAMSDDLASHQRFEVMERKLYRGIMWPAMIATLITAHFLVDWGDATQHYHEATWFYIKVALVGLLVIYHFVCGYYRKKLIGNAHYKSHKFWRFFNEMPTLLLLAIVILVVVKPQF

SEQ ID NO: 317 - protein, 150 aa, Acinetobacter
MNAPSDAFLWVKALHIIAVVCWFAALFYLPRLYVYHAMSDDAISHQRFQVMERKLYRGIMWPAMIATLITAHFLVAWGDATQHYHLAHWFYVKVALVGLLVIYHFVCGYYRKKLIENAHYKSHKFWRFFNEMPTVILLAVVILVVVKPQF

SEQ ID NO: 318 - protein, 150 aa, Acinetobacter
MNAPSDAFLWVKALHIIAVVCWFAALFYLPRLYVYHAMSDDAISHQRFQVMERKLYRGIMWPAMIATLITAHFLVAWGDATQHYHLAHWFYLKVALVGLLVIYHFVCGYYRKKLIENAHYKSHKFWRFFNEMPTVILLAVVILVVVKPQF

SEQ ID NO: 319 - protein, 150 aa, Acinetobacter
MDVPSDAFLWVKAFHIISIVCWFAALFYLPRLYVYHAMSNDAVSHQRFQVMERKLYRGIMWPSMIATLITAHFLVDWGDATQHYHEALWFYLKLGLVGLLVIYHLFCGYYRQKLILDAHYKSHKFWRFFNEMPTFILVAVIILVVVKPHF

SEQ ID NO: 320 - protein, 181 aa, Escherichia
MKTLILFSTRDGQTREIASYLASELKELGIQADVANVHRIEEPQWENYDRVVIGASIRYGHYHSAFQEFVKKHATRLNSMPSAFYSVNLVARKPEKRTPQTNSYARKFLMNSQWRPDRCAVIAGALRYPRYRWYDRFMIKLIMKMSGGETDTRKEVVYTDWEQVANFAREIAHLTDKPTLK

SEQ ID NO: 321 - protein, 181 aa, Escherichia; identical to SEQ ID NO: 320

SEQ ID NO: 322 - protein, 181 aa, Enterobacter
MKTLILFSTRDGQTREIASYLASELKELGIQADVTNVHRIEEPQWENYDRVVIGASIRYGHYHSAFQEFVKKHATRLNSMPSAFYSVNLVARKPEKRTPQTNSYARKFLMNSQWRPDRCAVIAGALRYPRYRWYDRFMIKLIMKMSGGETDTRKEVVYTDWEQVANFAREIAHLTDKPTLK

SEQ ID NO: 323 - protein, 181 aa, Shigella
MKTLILFSTRDGQTREIASYLASELKELGIQTDVANVHRIEEPQWENYDRVVIGASIRYGHYHSAFQEFVKKHATRLNSMPSAFYSVNLVARKPEKRTPQTNSYARKFLMNSQWRPDRCAVIAGALRYPRYRWYDRFMLKLIMKMSGGETDTRKEVVYTDWEQVANFAREIAHLTDKPTLK

SEQ ID NO: 324 - protein, 181 aa, Escherichia
MKTLILFSTRDGQTREIAAYLASELKELGIQADVANVHRIEEPQWENYDRVVIGASIRYGHYHSAFQEFVKKHATRLNSMPSAFYSVNLVARKPEKRTPQTNSYARKFLMSSQWRPDRCAVIAGALRYPRYRWYDRFMIKLIMKMSGGETDTRKEVVYTDWEQVANFAREIAHLTDKPTLK

SEQ ID NO: 325 - protein, 180 aa, Shigella
MKTLILFSTRDGQTREISSYLASELKELGIQTDVANVHRIEEPQWENYDRVVIGASIRYGHYHSAFQEFVKKHATRLNSMPSAFYSVNLVARKPEKRTPQTNSYARKFLMNSQWRPDRCAVIAGALRYPRYRWYDRFMLKLIMKMSGGETDTRKEVVTDWEQVANFAREIAHLTDKPTLK

SEQ ID NO: 326 - protein, 181 aa, Escherichia
MKTLILFSTRDGQTREIASYLASELKELGIQADVANVHRTEEPQWENYDRVVIGASIRYGHYHSAFQEFVKKHATRLNSMPSAFYSVNLVARKPEKRTPQTNSYARKFLMSSQWRPDRCAVIAGALRYPRYRWYDRFMIKLIMKMSGGETDTRKEVVYTDWEQVANFAREIAHLTDKPTLK

SEQ ID NO: 327 - protein, 181 aa, Escherichia
MKTLILFSTRDGQTREIASYLASELKELGIQADVANVHRIEEPQWENYDRVVIGASIRYGHYHSAFQEFVKKHATQLNSMPSAFYSVNLVARKPEKRTPQTNSYARKFLMNSQWRPDRCAVIAGALRYPRYRWYDRFMIKLIMKMSGGETDTRKEVVYTDWEQVANFAREIAHLTDKPTPK

SEQ ID NO: 328 - protein, 181 aa, Shigella
MKTLILFSTRDGQTREIASYLASELKELGIQTDVANVHRIEEPQWENYGRVVIGASIRYGHYHSAFQEFVKKHATRLNSMPSAFYSVNLVARKPEKRTPQTNSYARKFLMNSQWRPDRCAVIAGALRYPRYRWYDRFMLKLIMKMSGGETDTRKEVVYTDWEQVANFAREIAHLTDKPTLK

SEQ ID NO: 329 - protein, 181 aa, Escherichia
MKTLILFSTRDGQTREIASYLASELKELGIQADVANVHRIEEPQWENYDRVVIGASIRYGHYHSAFQEFVKKHATRLNSMPSAFYSVNLVARKPEKRTPQTNSYARKFLMSSQWRPDRCAVIAGALRYPRYRWYDRFMIKLIMKMSGGETDTRKEVVYTDWQQVENFAREIAHLTDKPTLK

SEQ ID NO: 330 - protein, 181 aa, Shigella
MKTLILFSTRDGQTREIASYLASELKELGIQTDVANVHRIEEPQWENYDRVVIGASIRYGHYHSAFQEFVKKHATRLNSMPSAFYSVNLVARKPEKRTPQTNSYARKFLMNSQWRPDRCAVIAGALRYPRYRWYDRFMIKLIMKMSGGETDTRKEVVYTDWEQVANFAREIAQLTNKPTLK

SEQ ID NO: 331 - protein, 181 aa, Escherichia
MKTLILFSTRDGQTREIASYLASELKELGIQADVANVHRTEEPQWENYDRVVIGASIRYGHYHSAFEEFVKKHETRLNSMPSAFYSVNLVARKPEKRTPQTNSYARKFLMSSQWRPDRCAVIAGALRYPRYRWYDRFMIKLIMKMSGGETDTRKEVVYTDWEQVANFAREIAHLTDKPTLK

SEQ ID NO: 332 - protein, 181 aa, Escherichia
MKTLILFSTRDGQTREIASYLASELKELGILADVANVHRTEEPQWENYDRVVIGASIRYGHYHSAFQEFVKKHATRLNSMPSAFYSVNLVARKPEKRTPQTNSYARKFLMSSQWRPDRCAVIAGALRYPRYRWYDRFMIKLIMKMSGGETDTRKEVVYTDWEQVANFAREIAHLTDKPTMK

SEQ ID NO: 333 - protein, 181 aa, Enterobacter
MKTLILFSTRDGQTREIASYLASELKELGIQTDVANVHRIEEPQWENYDRVVIGASIRYGHYHSAFQEFVKKHATRLNSMPSAFYSVNLVARKPEKRTPQTNSYARKFLMSSQWRPDRCAVIAGALRYPRYRWYDRFMIKLIMKMSGGETDTRKEVVYTDWEQVANFAREIAQLTNKPTLK

SEQ ID NO: 334 - protein, 181 aa, Shigella
MKTLILFSTRDGQTREIASYLASELKELGIQTDVANVHRIEEPQWKNYDRVVIGASIRYGHYHSAFQEFVKKHATRLNSMPSAFYSVNLVARKPEKRTPQTNSYARKFLMSSQWRPDRCAVIAGALRYPRYRWYDRFMIKLIMKMSGGETDTRKEVVYTDWEQVANFAREIAQLTNKPTLK

SEQ ID NO: 335 - protein, 181 aa, Shigella
MKTLILFSTRDGQTREIASYLASELKELGIQTDVANVHRIEEPQWENYDRVVIGASIRYGHYHSAFQEFVKKHATRLNSMPSAFYSVNLVARKPEKRTPQTNSYARKFLMSSQWRPDRCAVIAGALRYPRYCWYDRFMIKLIMKMSGGETDTRKEVVYTDWEQVANFAREIAQLTNKPTLK

SEQ ID NO: 336 - protein, 181 aa, Salmonella
MKTLILFSTRDGQTREIASYLASELKEMGIWADVVNLHRAEEPDWDSYDRVVIGASIRYGHYHSAFQEFVKKYATRLNGMPSAFYSVNLVARKAEKRTPQTNSYARKFLMSSPWRPDYCAVIAGALRYPRYRWYDRLMIKLIMKMSGGETDTRKEVVYTDWEQVANFAREIAHLTNKSSAK

SEQ ID NO: 337 - protein, 161 aa, Shigella
MASELKELGIQADVANVHRIEEPQWENYDRVVIGASIRYGHYHSAFQEFVKKHATRLNSMPSAFYSVNLVARKPEKRTPQTNSYARKFLMNSQWRPDRCAVIAGALRYPRYRWYDRFMIKLIMKMSGGETDTRKEVVYTDWEQVANFAREIAHLTDKPTLK

SEQ ID NO: 338 - protein, 181 aa, Citrobacter
MKTLILFSTRDGQTREIASYLASELKELGIWADVVNLHRTEEPEWDSYDRVVIGASIRYGHYHTAFQEFVKKHATRLNGMPSAFYSVNLVARKPEKRTPQTNSYARKFLMSSQWRPDRCAVIAGALLYPRYRWYDRIMIKLIMKMSGGETDTNKEVIYTDWEQVAGFAREIAQLTVKSPVK

SEQ ID NO: 339 - protein, 181 aa, Salmonella
MKTLILFSTRDGQTREIASYLASELKEMGIWADVVNLHRAEEPDWDSYDRVVIGASIRYGHYHSAFQEFVKKYATRLNGMPSAFYSVNLVARKAEKRTPQTNSYARKFLMSSPWRPDHCAVIAGALRYPRYRWYDRLMIKLIMKMSGGETDTSKEVVYTDWEQVANFAREIAHLTNKSSAK

SEQ ID NO: 340 - protein, 181 aa, Citrobacter
MKTLILFSTRDGQTREIASYLASELKELGIWADVINLHRTEELDWQSYDRVVIGASIRYGHYHAAFQEFVKKHATRLNAMPSAFYSVNLVARKPEKRTPQTNSYARKFLMSSQWRPDLCAVIAGALRYPRYRWYDRLMIKLIMKMSGGETDTSKEVVYTDWEQVANFARDIAQLTNKSLAK

SEQ ID NO: 341 - protein, 181 aa, Salmonella
MKTLILFSTRDGQTREIASYLASELKEMGIWADVVNLHRAEEPDWDSYDRVVIGASIRYGHYHSAFQEFVKKYATRLNGMPSAFYSVNLVARKAEKRTPQTNSYARKFLMSSPWRPDHCAVIAGALRYPRYRWYDRLMIKLIMKMSGGETDTSKEVVYTDWDQVANFAREIAHLTNKSSAK

SEQ ID NO: 342 - protein, 181 aa, Salmonella
MKTLILFSTRDGQTREIASYLASELKEMGIWADVVNLHRAEEPDWDSYDRVVIGASIRYGHYHSAFQEFVKKYATRLNGMPSAFYSVNLVARKAEKRTPQTNSYARKFLMSSPWRPDHCAVIAGALRYPRYRWYDRLMIKLIMKLSGGETDTSKEVVYTDWEQVANFAREIAHLTNKSSAK

SEQ ID NO: 343 - protein, 181 aa, Salmonella
MKTLILFSTRDGQTREIASYLASELKEMGIWADVVNLHRAEEPDWDKYDRVVIGASIRYGHYHSAFQEFVKKYSTRLNGMPSAFYSVNLVARKPEKRTPQTNSYARKFLMNSPWRPDHCAVIAGALRYPCYRWYDRLMIKLIMKMSGGETDTSKEVVYTDWDQVAKFAREIAHLTNKPSSK

SEQ ID NO: 344 - protein, 181 aa, Citrobacter
MKTLILFSTRDGQTREIASYLASELKELGIWADVINLHRTEELDWQSYDRVVIGASIRYGHYHAAFQEFVKKHATRLNAMPSAFYSVNLVARKPEKRTPQTNSYARKFLMSAQWRPDLCAVIAGALRYPRYRWYDRLMIKLIMKMSGGETDTSKEVVYTDWEQVANFARDIAQLTNKSLAK

SEQ ID NO: 345 - protein, 181 aa, Salmonella
MKTLILFSTRDGQTREIASYLASELKEMGIRADVVNLHRAEEPDWDSYDRVVIGASIRYGHYHSAFQEFVKKYATRLNGMPSAFYSVNLVARKAEKRTPQTNSYARKFLMSSPWRPDYCAVIAGALRYPRYRWYDRLMIKLIMKMSGGETDTSKEVVYTDWEQVAHFAREIAHLTNKSSAK

SEQ ID NO: 346 - protein, 181 aa, Citrobacter
MKTLILFSSRDGQTREIAAYLASELKELGIWADVFNLHRTEEPDWESYDRVVIGASIRYGHYHSAFLDFVKKHATRLNQMPSAFYSVNLVARKPEKRTPQTNSYARKFLMHSQWRPDRSAVIAGALLYPRYRWYDRIMIKLIMKMSGGETDTRKEVIYTDWEQVASFAREIAQLTDKSSVK

SEQ ID NO: 347 - protein, 181 aa, Salmonella
MKTLILFSTRDGQTREIASYLASELKEMGIWADVVNLHRAEEPDWDKYDRVVIGASIRYGHYHSAFQEFVKKYATRLNGMPSAFYSVNLVARKPEKRTPQTNSYARKFLMSSPWRPDHCAVIAGALRYPCYRWYDRLMIKLIMKMSGGETDTSKEVVYTDWDQVAKFAREIAHLTNKPSSK

SEQ ID NO: 348 - protein, 181 aa, Citrobacter
MKTLILFSTRDGQTREIASYLASELKALGIWADVINLHRTEELDWQSYDRVVIGASIRYGHYHAAFQEFVKKHATRLNAMPSAFYSVNLVARKPEKRTPQTNSYARKFLMSSQWRPDLCAVIAGALRYPRYRWYDRLMIKLIMKMSGGETDTSKEVVYTDWEQVANFARDIAQLTNKSLAK

SEQ ID NO: 349 - protein, 181 aa, Salmonella
MKTLILFSTRDGQTREIASYLASELKEMGIWADVVNLHRAEEPDWDSYDRVVIGASIRYGHYHSAFQEFVKKYATRLNGMPSAFYSVNLVARKAEKRTPQTNSYARKFLMSSPWRPDYCAVIAGALRYPRYRWYDRLMIKLIMKMSGGETDTSKEVVYTDWEQVAHFAREIAHLTNKSSAK

SEQ ID NO: 350 - protein, 181 aa, Salmonella
MKTLILFSTRDGQTREIASYLASELKEMGIWADVVNLHRAEEPDWDCYDRVVIGASIRYGHYHSAFQEFVKKYATRLNGMPSAFYSVNLVARKAEKRTPQTNSYARKFLMSSPWRPDYCAVIAGALRYPRYRWYDRLMIKLIMKMSGGETDTSKEVVYTDWEQVAHFAREIAHLTNKSSAK

SEQ ID NO: 351 - protein, 181 aa, Salmonella
MKTLILFSTRDGQTREIASYLASELKEMGIWADVVNLHRAEEPDWDSYDRVVIGASIRYGHYHSAFQEFVKKYATRLNGMPSAFYSVNLVSRKAEKRTPQTNSYARKFLMSSPWRPDYCAVIAGALRYPRYRWYDRLMIKLIMKMSGGETDTSKEVVYTDWEQVAHFAREIAHLTNKSSAK

SEQ ID NO: 352 - protein, 181 aa, Salmonella enterica
MKTLILFSTRDGQTREIASYLASELKDMGIWADVVNLHRAEEPDWDSYDRVVIGASIRYGHYHSAFQEFVKKYATRLNGMPSAFYSVNLVARKAEKRTPQTNSYARKFLMSSPWRPDYCAVIAGALRYPRYRWYDRLMIKLIMKMSGGETDTSKEVVYTDWEQVAHFAREIAHLTNKSSAK

SEQ ID NO: 353 - protein, 181 aa, Salmonella
MKTLILFSTRDGQTREIASYLASELKEMGIWGDVVNLHRAEEPDWDSYDRVVIGASIRYGHYHSAFQEFVKKYATRLNGMPSAFYSVNLVARKAEKRTPQTNSYARKFLMSSPWRPDYCAVIAGALRYPRYRWYDRLMIKLIMKMSGGETDTSKEVVYTDWEQVAHFAREIAHLTNKSSAK

SEQ ID NO: 354 - protein, 181 aa, Salmonella
MKTLILFSTRDGQTREIASYLASELKEMGIWADVVNLHRAEEPDWDSYDRVVIGASIRYGHYHSAFQEFVKKYATRLNGMPSAFYSVNLVARKAEKRTPQTNSYARKFLMSSPWRPDYCAVIAGALRYPRYRWYDRLMIKFIMKMSGGETDTSKEVVYTDWEQVAHFAREIAHLTNKSSAK

SEQ ID NO: 355 - protein, 181 aa, Salmonella
MKTLILFSTRDGQTREIASYLASELKEMGIWADVVNLHRAEEPDWDSYDRVVIGASIRYGHYHSAFQEFVKKYATRLNGMPSAFYSVNLVARKAEKRTPQTNSYARKFLMSSPWRPDYCAVIAGALRYPRYRWYDRLMIKLIMKMSGGETDTSKEAVYTDWEQVAHFAREIAHLTNKSSAK

SEQ ID NO: 356 - protein, 181 aa, Salmonella
MKTLILFSTRDGQTREIASYLASELKEMGIWADVVNLHRAEEPDWDSYDRVVIGASIRYGHYHSAFQEFVKKYATRLNGMPSAFYSVNLVARKAEKRTPQTNSYARKFLMSSPWRPDYCAVIAGALRYPRYRWYDRLMIKLIMKMSGGETDTSKEVVYTDWEQVTHFAREIAHLTNKSSAK

SEQ ID NO: 357 - protein, 181 aa, Salmonella
MKTLILFSTRDGQTHEIASYLASELKEMGIWADVVNLHRAEEPDWDSYDRVVIGASIRYGHYHSAFQEFVKKYATRLNGMPSAFYSVNLVARKAEKRTPQTNSYARKFLMSSPWRPDYCAVIAGALRYPRYRWYDRLMIKLIMKMSGGETDTSKEVVYTDWEQVAHFAREIAHLTNKSSAK

SEQ ID NO: 358 - protein, 181 aa, Salmonella
MKTLILFSTRDGQTREIASYLASELKEMGIWADVVNLHRAEEPDWDSYDRVVIGASIRYGHYHSAFQEFVKKYAKRLNGMPSAFYSVNLVARKAEKRTPQTNSYARKFLMSSPWRPDYCAVIAGALRYPRYRWYDRLMIKLIMKMSGGETDTSKEVVYTDWEQVAHFAREIAHLTNKSSAK

SEQ ID NO: 359 - protein, 181 aa, Salmonella
MKTLILFSTRDGQTREIASYLASELKEMGIWADVVNLHRAEEPDWDSYDRVVIGASIRYGHYHSAFQEFVKKYATRLNGMPSAFYSVNLVARKAEKRTPQTNSYARKFLMSSPWRPDYCAVIAGALRYPRYRWYDRLMIKLIMQMSGGETDTSKEVVYTDWEQVTHFAREIAHLTNKSSAK

SEQ ID NO: 360 - protein, 181 aa, Salmonella
MKTLILFSTWDGQTREIASYLASELKEMGIWADVVNLHRAEEPDWDSYDRVVIGASIRYGHYHSAFQEFVKKYATRLNGMPSAFYSVNLVARKAEKRTPQTNSYARKFLMSSPWRPDYCAVIAGALRYPRYRWYDRLMIKLIMKMSGGETDTSKEVVYTDWEQVAHFAREIAHLTNKSSAK

SEQ ID NO: 361 - protein, 181 aa, Salmonella
MKTLILFSTRDGQTREIASYLASELKEMGIWADVVNLHRAEEPDWDKYDRVVIGASIRYGHYHSAFQEFVKKYATRLNGMPSAFYSVNLVARKPEKRTPQTNSYARKFLMSSPWRPDYCAVIAGALRYPCYRWYDRLMIKLIMKMSGGETDTSKEVVYTDWDQVAKFAREIAHLTNKLSSK

SEQ ID NO: 362 - protein, 181 aa, Salmonella
MKTLILFSTRDGQTREIASYLASELKEMGIWGDVVNLHRAEEPDWDSYDRVVIGASIRYGHYHSAFQEFVKKYATRLNGMPSAFYSVNLVARKAEKRTPQTNSYARKFLMSSPWRPDYCAVIAGALRYPSYRWYDRLMIKLIMKMSGGETDTSKEVVYTDWEQVAHFAREIAHLTNKSSAK

SEQ ID NO: 363 - protein, 181 aa, Salmonella
MKTLILFSTRDGQTREIASYLASELKEMGIWADVVNLHRAEEPDWDSYDRVVIGASIRYGHYHSAFQEFVKKYATRLNGMPSAFYSVNLVARKAEKRTPQTNSYARKFLMSSPWRPDYCAVIAGALRYPRYRWYDRLMIKLIMKMSGGETDTSKEVVYTDWEQVTHFAREIAHLNNKSSAK

SEQ ID NO: 364 - protein, 181 aa, Salmonella
MKILILFSTRDGQTREIASYLASELKEMGIWADVVNLHRAEEPDWDSYDRVVIGASIRYGHYHSAFQEFVKKYAPRLNGMPSAFYSVNLVARKAEKRTPQTNSYARKFLMSSPWRPDHCAVIAGALRYPRYRWYDRLMIKLIMKMSGGETDTSKEVVYTDWDQVANFAREIAHLTNKSSAK

SEQ ID NO: 365 - protein, 181 aa, Citrobacter
MKTLILFSSRDGQTREIAAYLASELKELGICTDVVNLHRIEEPDWERYDRVVIGASIRYGHYHSAFLEFVKKHATRLNHMPSAFYSVNLVARKPEKRTPQTNSYARKFLMNSQWRPDRSAVIAGALLYPRYRWYDRMMIQLIMKMSGGETDTRKEVIYTDWEQVASFAREVAQLTPDSLVK

SEQ ID NO: 366 - protein, 176 aa, Salmonella
MKTLILFSTRDGQTREIASYLASELKEMGIWADVVNLHRAEEPDWDSYDRVVIGASIRYGHYHSAFQEFVKKYATRLNGMPSAFYSVNLVARKAEKRTPQTNSYARKFLMSSPWRPDYCAVIAGALRYPRYRWYDRLMIKLIMKMSGGETDTSKEVVYTDWEQVAHFAREIAHLTN

SEQ ID NO: 367 - protein, 181 aa, Salmonella
MKTLILFSTRDGQTREIASYLASELKEMGIWADVVNLHRAEEPDWDSYDRVVIGASIRYGHYHSAFQEFVKKYATRLNGMSSAFYSVNLVARKAEKRTPQTNSYARKFLMSSPWRPDYCAVIAGALRYPRYRWYDRLMIKLIMKMSGGETDTSKEVVYTDWEQVTHFAREIAHLTNKSSAK

SEQ ID NO: 368 - protein, 181 aa, Salmonella
MKTLILFSTRDGQTREIASYLASELKEMGIWADVVNLHRAEELDWDSYDRVVIGASIRYGHYHSSFQEFVKKYATRLNGMPSAFYSVNLVARKAEKRTPQTNSYARKFLMSSPWRPDYCAVIAGALRYPRYRWYDRLMIKLIMKMSGGETDTSKEVVYTDWEQVAHFAREIAHLTNKSSAK

SEQ ID NO: 369 - protein, 181 aa, Citrobacter
MKTLILFSSRDGQTREIAEYLASELKELGVWADVVNLHRTEEPDWKNYDSVVIGASIRYGHYHTAFQEFVKKHATRLNAMPSAFYSVNLVARKPEKRTPQTNSYARKFLMSSPWRPDRSAVIAGALLYPRYRWYDRVMIKLIMKMSGGETDTSKEVVYTDWEQVAIFAREIAQLTNKALLK

SEQ ID NO: 370 - protein, 181 aa, Citrobacter
MKTLILFSSRDGQTREIAAYLASELKELGVCTDVVNLHRTEEPDWERYDRVVIGASIRYGHYHSAFLEFVKKHATRLNHMPSAFYSVNLVARKPEKRTPQTNSYARKFLMNSQWRPDRSAVIAGALLYPRYRWYDRMMIQLIMKMSGGETDTRKEVIYTDWEQVASFAREIAQLTPDSVVK

SEQ ID NO: 371 - protein, 181 aa, Shigella
MKTLILFSSRDGQTREIAEYLASELKELGVWADVMNLHRTEEPEWKNYDSVVIGASIRYGHYHSAFQEFVKKHATQLNTMPSAFYSVNLVARKPEKRTPQTNSYARKFLMSSPWRPDHSAVIAGALLYPRYRWYDRVMIQLIMKMSGGETDTKKEVIYTDWEQVAGFAREIAQLTNKTLLK

SEQ ID NO: 372 - protein, 181 aa, Citrobacter
MKTLILFSSRDGQTREIAEYLASELKELGVWADVVNLHRTAEPDWQNYDSVVIGASIRYGHYHAAFQEFVKKHATRLNSMPSAFYSVNLVARKPEKRTPQTNSYARKFLMSSPWRPDHSAVIAGALLYPRYRWYDRVMIQLIMKMSGGETDTNKEVVYTDWEQVARFAREIAQLTNKASLK

SEQ ID NO: 373 - protein, 181 aa, Enterobacter
MKTLILFSSRDGQTREIAEYLASELKELGVWADVVNLHRTAEPDWQNYDSVVIGASIRYGHYHAAFQEFVKKHATRLNSMPSAFYSVNLVARKPEKRTPQTNSYARKFLMSSPWRPDHSAVIAGALLYPRYRWYDRVMIQLIMKMSGGETDTNKEVVYTDWEQVARFAREIAQLTNKTSLK

SEQ ID NO: 374 - protein, 174 aa, Salmonella
MKTLILFSTRDGQTREIASYLASELKEMGIWADVVNLHRAEEPDWDSYDRVVIGASIRYGHYHSAFQEFVKKYATRLNGMPSAFYSVNLVARKAEKRTPQTNSYARKFLMSSPWRPDYCAVIAGALRYPRYRWYDRLMIKLIMKMSGGETDTSKEVVYTDWEQVTHFAREIAHL

SEQ ID NO: 375 - protein, 181 aa, Citrobacter
MKTLILFSSRDGQTREIAEYLASELKELGVWADVVNLHRTAEPDWQNYDSVVIGASIRYGHYHAAFQEFVKKHATRLNSMPSAFYSVNLVARKPEKRTPQTNSYARKFLMGSPWRPDHSAVIAGALLYPRYRWYDRVMIQLIMKMSGGETDTNKEVVYTDWEQVARFAREIAQLTNKTSLK

SEQ ID NO: 376 - protein, 181 aa, Citrobacter
MKTLILFSSRDGQTREIAEYLASELKELGVWADVLNLHRTAEPDWQNYDSVVIGASIRYGHYHAAFQEFVKKHATRLNAMPSAFYSVNLVARKPEKRTPQTNSYARKFLMSSPWRPDRSAVIAGALRYPRYRWYDRVMIQLIMKMSGGETDTHKEVVYTDWEQVAGFAREIAQLTHKTVSK

SEQ ID NO: 377 - protein, 181 aa, Citrobacter
MKTLILFSSRDGQTREIAEYLASELKELGVWADVVNLHRTAEPDWQNYDSVVIGASIRYGHYHAAFQEFVKKHATRLNSMPSAFYSVNLVARKPEKRTPQTNSYARKFLMSSPWRPDHSAVIAGALLYPRYRWYDRVMIQLIMKMSGGETDTNKEVVYTDWEQVARFAREIAQLTNKALLK

SEQ ID NO: 378 - protein, 181 aa, Citrobacter
MKTLILFSSRDGQTREIAEYLASELKELGVWADVVNLHRTAEPDWQNYDSVVIGASIRYGHYHAAFQEFVKKHATRLNAMPSAFYSVNLVARKPEKRTPQTNSYARKFLMSSPWRPDRSAVIAGALLYPRYRWYDRVMIQLIMKMSGGETDTNKEVVYTDWEQVAGFAREIAQLTNKTLSK

SEQ ID NO: 379 - protein, 181 aa, Citrobacter
MKTLILFSSRDGQTREIAEYLASELKELGVWADVVNLHRTAEPDWQNYDSVVVGASIRYGHYHAAFQEFVKKHATRLNAMPSAFYSVNLVARKPEKRTPQTNSYARKFLMSSPWRPDRSAVIAGALLYPRYRWYDRVMIQLIMKMSGGETDTNKEVVYTDWEQVAGFAREIAQLTNKTLSK

SEQ ID NO: 380 - protein, 181 aa, Citrobacter
MKTLILFSSRDGQTREIAEYLASELKELGVWADVVNLHRTAEPDWQNYDSVVIGASIRYGHYHAAFQEFVKKHATRLNAMPSAFYSVNLVARKPEKRTPQTNSYARKFLMSSPWRPDRSAVIAGALLYPRYRWYDRVMIQLIMKMSGGETDTNKEVVYTDWEQVADFAREIAQLTHKTLSK

SEQ ID NO: 381 - protein, 181 aa, Citrobacter
MKTLILFSSRDGQTQEIAAYLASELKELGISTDVVNLHRTDEPDWERYDRVVIGASIRYGHYHSAFLAFVKKHATRLNRMPSAFYSVNLVARKPEKRTPQTNSYARKFLMNSQWRPDRSAVIAGALLYPRYRWYDRMMIQLIMKMSGGETDTRKEVIYTDWAQVASFAREIAQLTPDSLVK

SEQ ID NO: 382 - protein, 181 aa, Citrobacter
MKTLILFSSRDGQTREIAEYLASELKELGVWADVVNLHRTAEPDWQNYDSVVIGASIRYGHYHAAFQEFVKKYATRLNSMPSAFYSVNLVARKPEKRTPQTNSYARKFLMSSPWRPDHSAVIAGALLYPRYRWYDRVMIQLIMKMSGGETDTNKEVVYTDWEQVARFAREIAQLTNKALLK

SEQ ID NO: 383 - protein, 181 aa, Citrobacter
MKTLILFSSRDGQTREIAEYLASELKELGVWADVVNLHRTAEPDWQHYDSVVIGASIRYGHYHAAFQEFVKKHATRLNAMPSAFYSVNLVARKPEKRTPQTNSYARKFLMSSPWRPDRSAVIAGALLYPRYRWYDRVMIQLIMKMSGGETDTNKEVVYTDWEQVADFAREIAQLTHKTLSK

SEQ ID NO: 384 - protein, 181 aa, Citrobacter
MKTLILFSSRDGQTREIAEYLASELKELGVWTDVVNLHRTAEPDWQNYDSVVIGASIRYGHYHAAFQEFVKKHATRLNAMPSAFYSVNLVARKPEKRTPQTNSYARKFLMSSPWRPDRSAVIAGALLYPRYRWYDRVMIQLIMKMSGGETDTHKEVVYTDWEQVAGFAREIAQLTHKTLPK

SEQ ID NO: 385 - protein, 187 aa, Salmonella
MNNGVTRENIDSFSTRDGQTREIASYLASELKEMGIWADVVNLHRAEEPDWDSYDRVVIGASIRYGHYHSAFQEFVKKYATRLNGMPSAFYSVNLVARKAEKRTPQTNSYARKFLMSSPWRPDYCAVIAGALRYPRYRWYDRLMIKLIMKMSGGETDTSKEVVYTDWEQVTHFAREIAHLTNKSSAK

SEQ ID NO: 386 - protein, 181 aa, Citrobacter
MKTLILFSSRDGQTREIAEYLASELKELGVWTDVVNLHRTAEPDWKNYDSVVIGASIRYGHYHSAFQEFVKKYATRLNAMPSAFYSVNLVARKPEKRTPQTNSYARKFLMSSPWRPDRSAVIAGALLYPRYRWYDRVMIQLIMKMSGGETDTNKEVVYTDWEQVAGFAREIAQLTHKTLPK

SEQ ID NO: 387 - protein, 171 aa, Salmonella
DGQTREIASYLASELKEMGIWADVVNLHRAEEPDWDSYDRVVIGASIRYGHYHSAFQEFVKKYATRLNGMPSAFYSVNLVARKAEKRTPQTNSYARKFLMSSPWRPDYCAVIAGALRYPRYRWYDRLMIKLIMKMSGGETDTSKEVVYTDWEQVAHFAREIAHLTNKSSAK

SEQ ID NO: 388 - protein, 181 aa, Enterobacter
MKTLILFSTRDGQTREIAAYLASELKELGIYSDVVNLNRAEQIAWQDYDRVVIGASIRYGHFHPALDRFVKKHTAVLNKLPGAFYSVNLVARKAEKRTPQTNSYTRKFLLNSPWQPDLCAVFAGALRYPRYRWYDRFMIRLIMKMTGGETDTRKEVVYTDWSQVASFAREIAHLTDNSRLK

SEQ ID NO: 389 - protein, 181 aa, Enterobacter
MKTLILFSTRDGQTREIAAYLASELKELGIYSDVVNLNRVEQISWQDYDRVVIGASIRYGHFHPALDRFVKKHTAVLNKLPGAFYSVNLVARKPEKRTPQTNSYTRKFLLSSPWQPELCAVFAGALRYPRYRWYDRFMIRLIMKMTGGETDTRKEVVYTDWSQVASFAREIAHLTDDSRHK

SEQ ID NO: 390 - protein, 181 aa, Enterobacter
MKTLILFSTRDGQTREIAAYLASELKELGIYSDVVNLNRAEQISWQDYDRVVIGASIRYGHFHPALDRFVKKHTAVLNKLPGAFYSVNLVARKPEKRTPQTNSYTRKFLLNSPWQPDLCAVFAGALRYPRYRWYDRFMIRLIMKMTGGETDTRKEVVYTDWSQVASFAREIAHLTGDSRHK

SEQ ID NO: 391 - protein, 181 aa, Enterobacter
MKTLILFSTRDGQTREIAAYLASELKELGIYSDVVNLNRAEQIAWQDYDRVVIGASIRYGHFHPALDRFVKKHAAVLNKMPGAFYSVNLVARKAEKRTPQTNSYTRKFLLSSPWQPDLCAVFAGALRYPRYRWYDRFMIRLIMKMTGGETDTRKEVVYTDWSQVASFAREIAHLTGDSRLK

SEQ ID NO: 392 - protein, 181 aa, Enterobacter
MKTLILFSTRDGQTREIAAYLASELKELGIYSDVVNLNRAEQIAWQDYDRVVIGASIRYGHFHPALDRFVKKHTAVLNKLPGAFYSVNLVARKAEKRTPQTNSYTRKFLLNSPWQPDLCAVFAGALRYPRYRWYDRFMIRLIMKMTGGETDTRKEVVYTDWSQVASFAREIAHLTGNSRLK

SEQ ID NO: 393 - protein, 181 aa, Enterobacter
MKTLILFSTRDGQTREIAAYLASELKELGIYSDVVNLNRADQITWQDYDRVVIGASIRYGHFHPALDRFVKKHTAKLNTLPGAFYSVNLVARKPEKRTPQTNSYTRKFLLNSPWQPELCAVFAGALRYPRYRWYDRFMIRLIMKMTGGETDTRKEVVYTDWSQVASFAREIAHLTGDSRHK

SEQ ID NO: 394 - protein, 181 aa, Enterobacter
MKTLILFSTRDGQTREIASYLASELKELGIYSDVVNLNRTEQITWQDYDRVVIGASIRYGHFHPALDRFVKKHTAVLNKLPGAFYSVNLVARKAEKRTPQTNSYTRKFLLNSPWRPDLCAVFAGALRYPRYRWYDRFMIRLIMKMTGGETDTRKEVVYTDWSQVASFAREIAHLSRDSQRK

SEQ ID NO: 395 - protein, 181 aa, Enterobacter
MKTLILFSTRDGQTREIAAYLASELKELGIYSDVVNLNRAEQITWQEYDRVVIGASIRYGHFHPALDRFVKKHTAVLNKLPGAFYSVNLVARKAEKRTPQTNSYTRKFLLSSPWQPDLCAVFAGALRYPRYRWYDRFMIRLIMKMTGGETDTRKEVVYTDWSQVASFAREIAHLTDDSRLK

SEQ ID NO: 396 - protein, 181 aa, Enterobacter
MKTLILFSTRDGQTREIAAYLASELKELGIYSDVVNLNRAEQIAWQDYDRVVIGASIRYGHFHPALDRFVKKHTAVLNKMPGAFYSVNLVARKAEKRTPQTNSYTRKFLLSSPWQPDLCAVFAGALRYPRYRWYDRFMIRLIMKMTGGETDTRKEVVYTDWSQVASFAREIAHLTGDSRLK

SEQ ID NO: 397 - protein, 181 aa, Enterobacter
MKTLILFSTRDGQTREIAAYLASELKELGIYSDVVNLNRAEQIAWQDYDRVVIGASIRYGHFHPALDRFVKKHTAILNKMPGAFYSVNLVARKAEKRTPQTNSYTRKFLLSSPWQPDLCAVFAGALRYPRYRWYDRFMIRLIMKMTGGETDTRKEVVYTDWSQVASFAREIAHLTGDSRLK

SEQ ID NO: 398 - protein, 180 aa, Enterobacter
MKTLILFSTRDGQTREIAAYLASELKELGIYSDVVNLNRAEQIAWQDYDRVVIGASIRYGHFHPALDRFVKKHTAVLNKMPGAFYSVNLVARKAEKRTPQTNSYTRKFLLSSPWQPDLCAVFAGALRYPRYRWYDRFMIRLIMKMTGGETDTRKEVVTDWSQVATFAREIAHLTGDSRLK

SEQ ID NO: 399 - protein, 181 aa, Enterobacter
MKTLILFSTRDGQTREIASYLASELKELGVYADVVNLNRTEEISWQDYDRVVIGASIRYGHFHPALDSFVKKHTAVLNALPGAFYSVNLVARKAEKRTPQTNSYTRKFLLGSPWQPDLCAVFAGALRYPRYRWYDRFMIRLIMKMTGGETDTRKEVVYTDWAQVASFAREIAQLTADSKVK

SEQ ID NO: 400 - protein, 181 aa, Enterobacter
MKTLILFSTRDGQTREIASYLASELQELGIYSDVVNLNRTEQIAWQDYDRVVIGASIRYGHFHPALDRFVKKHTAALNKLPGAFYSVNLVARKPEKRTPQTNSYTRKFLLNSPWQPDLCAVFAGALRYPRYRWYDRFMIRLIMKMTGGETDTRKEVVYTDWTQVSSFAREIAHLSPESRRI

SEQ ID NO: 401 - protein, 181 aa, Enterobacter
MKTLILFSTRDGQTREIAAYLASELKELGIYSDVVNLNRAEQIAWHDYDRVVIGASIRYGHFHPALDRFVKKHTAVLNKMPGAFYSVNLVARKAEKRTPQTNSYTRKFLLSSPWQPDLCAVFAGALRYPRYRWYDRFMIRLIMKMTGGETDTRKEVVYTDWSQVASFAREIAHLTGDSRLK

SEQ ID NO: 402 - protein, 181 aa, Enterobacter
MKTLILFSTRDGQTREIAAYLASELKELGIYSDVVNLNRAEQIAWQDYDRVVIGASIRYGHFHPALDRFVKKHTAKLNALPGAFYSVNLVARKAEKRTPQTNSYTRKFLLSSPWQPDLCAVFAGALRYPRYRWYDRFMIRLIMKMTGGETDTRKEVVYTDWSQVASFAREIAHLTGDSRHK

SEQ ID NO: 403 - protein, 181 aa, Enterobacter
MKTLILFSTRDGQTREIASYLASELQELGIYSDVVNLNRTEQIAWQDYDRVVIGASIRYGHFHPALDRFVKKHTAALNKLPGAFYSVNLVARKPEKRTPQTNSYTRKFLLNSPWQPDLCAVFAGALRYPRYRWYDRFMIRLIMKMTGGETDTRKEVVYTDWTQVSSFARDIAHLSPESRRI

SEQ ID NO: 404 - protein, 181 aa, Enterobacter
MKTLILFSTRDGQTREIAAYLASELKELGIYSDVVNLNRAEQIAWQEYDRVVIGASIRYGHFHPALDRFVKKHTAVLNKLPGAFYSVNLVARKAEKRTPQTNSYTRKFLLSSPWQPDLCAVFAGALRYPRYRWYDRFMIRLIMKMTGGETDTRKEVVYTDWSQVASFAREIAHLTGDSRLK

SEQ ID NO: 405 - protein, 181 aa, Enterobacter
MKTLILFSTRDGQTREIAAYLASELKELGIYSDVVNLNRAEEIAWQEYDRVVIGASIRYGHFHPALDRFVKKHTAVLNTLPGAFYSVNLVARKAEKRTPQTNSYTRKFLLGSPWQPDLCAVFAGALRYPRYRWYDRFMIRLIMKMTGGETDTRKEVVYTDWSQVASFAREIAHLAGDSRLK

SEQ ID NO: 406 - protein, 181 aa, Enterobacter
MKTLILFSTRDGQTREIAAYLASELKELGIYSDVVNLNRAEQIAWQDYDRVVIGASIRYGHFHPALDRFVKKHTAVLNKMPGAFYSVNLVARKAEKRTPQTNSYTRKFLLSSPWQPDLCAVFAGALRYPRYRWYDRFMIRLIMKMTGGETDTHKEVVYTDWSQVASFAREIAHLTGDSRLK

SEQ ID NO: 407 - protein, 181 aa, Enterobacter
MKTLILFSTRDGQTREIASYLASELKELGIYSDVVNLNRTEQIAWQDYDRVVIGASIRYGHFHPALDRFVKKHTAVLNKLPGAFYSVNLVARKPEKRTPQTNSYTRKFLLSSPWQPDISAVFAGALRYPRYRWYDRFMIRLIMKMTGGETDTRKEVVYTDWSQVASFAREIAHLSGDSRLK

SEQ ID NO: 408 - protein, 181 aa, Enterobacter
MKTLILFSTRDGQTREIAAYLASELKELGIYSDVVNLNRAEQIAWQEYDRVVIGASIRYGHFHPALDRFVKKHTAVLNKLPGAFYSVNLVARKAEKRTPQTNSYTRKFLLGSPWQPDLCAVFAGALRYPRYRWYDRFMIRLIMKMTGGETDTRKEVVYTDWSQVASFAREIAHLTGDSRLK

SEQ ID NO: 409 - protein, 181 aa, Enterobacter
MKTLILFSTRDGQTREIAAYLASELKELGIYSDVVNLNRAEQITWQEYDRVVIGASIRYGHFHPALVRFVKKHTAVLNKLPGAFYSVNLVARKAEKRTPQTNSYTRKFLLSSPWQPALCAVFAGALRYPRYRWYDRFMIRLIMKMTGGETDTRKEVVYTDWSQVASFAREIAHLTDDSRLK

SEQ ID NO: 410 - protein, 181 aa, Enterobacter
MKTLILFSTRDGQTREIAAYLASELKELGIYSDVVNLNRVGQITWQDYDRVVIGASIRYGHFHPALDRFVKKHTAVLNKLPGAFYSVNLVARKAEKRTPQTNSYTRKFLLNSPWQPDLCAVFAGALRYPRYRWYDRFMIRLIMKMTGGETDTRKEVVYTDWSQVASFAREIAHLSGDSRVK

SEQ ID NO: 411 - protein, 299 aa, Escherichia [sequence omitted]

SEQ ID NO: 412 - protein, 299 aa, Escherichia
MKPDAHQVKQFLLNLQDTICQQLTAVDGAEFVEDSWQREAGGGGRSRVLRNGGVFEQAGVNFSHVHGEAMPASATAHRPELAGRSFEAMGASLVVHPHNPYVPTSHANVRFFIAEKPGADPVWWFGGGFDLTPFYGFEEDAIHWHRTARDLCLPFGEDVYPRYKKWCDEYFYLKHRNEQRGIGGLFFDDLNTPDFDRCFAFMQAVGKGYTDAYLPIVERRKAMAYGERERNFQLYRRGRYVEFNLVWDRGTLFGLQTGGRTESILMSMPPLVRWEYDYQPKDGSPEAALSEFIKVRDWV

SEQ ID NO: 413 - protein, 299 aa, Shigella
MKPDAHQVKQFLLNLQDTICQQLTAVDGAEFVEDSWQREAGGGGRSRVLRNGGIFEQAGVNFSHVHGEAMPASATAHRPELAGRSFEAMGVSLVVHPHNPYVPTSHANVRFFIAEKPGAEPVWWFGGGFDLTPFYGFEEDAIHWHRTARDLCLPFGEDVYPRYKKWCDDYFYLKHRNEQRGIGGLFFDDLNTPDFDHCFAFMQAVGKGYTDAYLPIVERRKAMAYGERERNFQLYRRGRYVEFNLVWDRGTLFGLQTGGRTESILMSMPPLVRWEYDYQPKDGSPEAALSEFIKVRDWV

SEQ ID NO: 414 - protein, 299 aa, Citrobacter
MKPDAQRVKQFLLSLQDDICQRLSAVDGAEFIEDSWQREAGGGGRSRVLRNGGIFEQAGVNFSHVHGDAMPASATAHRPELAGRSFEAMGVSLVVHPLNPYIPTSHANVRFFIAEKPGADPVWWFGGGFDLTPYYGIEEDAVHWHRTARDLCQPFGEDVYPRYKKWCDDYFFLKHRNEQRGIGGLFFDDLNTPDFDRCFAFMQAVGKGYTDAYLPIVGRRKTMSWGERERNFQLYRRGRYVEFNLVWDRGTLFGLQTGGRTESILMSMPPLVRWEYDYHPEDGSPEAALSDFIQVRDWV

SEQ ID NO: 415 - protein, 299 aa, Citrobacter
MKPDAQRVKQFLLTLQESICGQLCAVDGAQFVEDSWQREAGGGGRSRVLRNGGVFEQAGVNFSHVHGDAMPASATAHRPELAGRSFEAMGVSLVVHPLNPYIPTSHANVRFFIAEKPGADPVWWFGGGFDLTPYYGFAEDAVHWHRTARDLCLPFGEEVYPRYKKWCDDYFFLKHRNEQRGIGGLFFDDLNTPDFDHCFAFMQAVGKGYTEAYLPIVERRKAMIWGERERNFQLYRRGRYVEFNLVWDRGTLFGLQTGGRTESILMSMPPLVRWEYDWQPEDGSPEAALSEFIKARDWV

SEQ ID NO: 416 - protein, 308 aa, Salmonella
MKPDAHHVKQFLLRLQDDICQTLSAVDGVNFVEDSWRREAGGGGRSRVLRNGGIFEQAGVNFSHVHGDAMPASATAHRPELAGRSFEAMGVSLVVHPHNPYIPTSHANVRFFIAEKPGADPVWWFGGGFDLTPYYGFEEDAVHWHRTARDLCQPFGDDVYPRYKKWCDDYFYLKHRNEQRGVGGLFFDDLNTPDFDHCFAFMQAVGHGYTGAYLPIVERRKAMVWGERERNFQLYRRGRYVEFNLVWDRGTLFGLQTGGRTESILMSMPPLVRWEYGYQPEEGSPEAALCEFIQVRDWVSLPDNSSVS

SEQ ID NO: 417 - protein, 299 aa, Citrobacter
MKPDAQRVKQFLLSLQDNICQQLSAVDGAEFVEDNWQREAGGGGRSRVLRNGGIFEQAGVNFSHVHGEAMPASATAHRPELAGRSFEAMGVSLVVHPQNPYIPTSHANVRFFIAEKPGADPVWWFGGGFDLTPYYGFDEDAVHWHRTARDLCQPFGDDVYPRYKKWCDDYFFLKHRNEQRGIGGLFFDDLNTPDFDHCFAFMQAVGQGYTEAYLPIVERRKAMSWSERERDFQLYRRGRYVEFNLVWDRGTLFGLQTGGRTESILMSMPPLVRWEYDWQPEANSPEAALSEFIQVRDWV

SEQ ID NO: 418 - protein, 299 aa, Rhizobium [sequence omitted]

SEQ ID NO: 419 - protein, 299 aa, Vibrio
MKPDALRVKQFLLNLQDAICQQLTAIDGAEFVEDSWQRDAGGGGRSRVLRNGGIFEQAGVNFSHVHGDAMPASATAHRPELAGRSFEAMGVSLVVHPLNPYIPTSHANVRFFIAEKPDADPVWWFGGGFDLTPYYGFEEDAIHWHRTARDLCQPFGDDVYPRYKKWCDDYFFLKHRNEQRGIGGLFFDDLNTPDFDHCFAFMQAVGEGYTEAYLPIVERRKAMSWGERERNFQLYRRGRYVEFNLVWDRGTLFGLQTGGRTESILMSMPPLVRWEYDWQPDAGSPEAALSDFIQVREWV

SEQ ID NO: 420 - protein, 299 aa, Enterobacter
MKPDAQQVKTFLLALQDSICQQLAAVDGQTFSEDNWQRDGGGGGRSRVLRNGGVFEQAGVNFSHVHGDAMPASATAHRPELAGRSFEAMGVSLVVHPHNPYVPTSHANVRFFIAEKPGADPVWWFGGGFDLTPYYGFEEDAVHWHRTARDLCLPFGEDVYPRYKKWCDDYFYLRHRQEQRGIGGLFFDDLNTPDFDRCFAFMQAVGNGYTDAYLPIVERRKAMAFGERERDFQLYRRGRYVEFNLVWDRGTLFGLQTGGRTESILMSMPPLVRWEYDYQPEDGSPEAALSEFIRVRDWV

SEQ ID NO: 421 - protein, 299 aa, Enterobacter
MTVDANKVKTFLLQLQDDICQQLSALDGGAFIEDSWQRDAGGGGRSRVLRDGGIFEQAGVNFSHVHGDAMPASATAHRPELAGRSFEAMGVSLVVHPRNPYVPTSHANVRFFIAEKPGADPVWWFGGGFDLTPFYGFEEDAIHWHRTARDLCQPFGEDVYPRYKKWCDDYFFIKHRNEQRGIGGLFFDDLNTPDFDSCFAFMQAVGNGFTDAYLPIVKRRKAAIWGERERNFQLYRRGRYVEFNLVWDRGTLFGLQTGGRTESILMSMPPLVRWEYDYQPQAGSPEAALSEFIKVRDWV

SEQ ID NO: 422 - protein, 299 aa, Enterobacter
MKPDVQQVKAFLLQLQDAICAKLSAVDGKDFVEDSWQREGGGSGRSRVLRDGGIFEQAGVNFSHVHGDAMPASATAHRPELAGRSFEAMGVSLVVHPRNPYVPTSHANVRFFIAEKPGADPVWWFGGGFDLTPYYGFEEDAIHWHRTARDLCLPYGDEVYPRYKKWCDDYFFLKHRNEQRGIGGLFFDDLNTPDFDHCFAFMQAVGNGFTDAYLPIVERRKTTPYGERERDFQLYRRGRYVEFNLVWDRGTLFGLQTGGRTESILMSMPPLVRWEYDYHPQEGSPEAALSEFIKVKEWI

SEQ ID NO: 423 - protein, 300 aa, Kluyvera
MTINVQQVKAFLLKLQDDICQQLERVDGGTFIEDSWQREAGGGGRSRVLRDGSVFEQAGVNFSHVHGDAMPASATAHRPELAGRSFEAMGVSLVVHPRNPYVPTSHANVRFFIAEKPGAEPVWWFGGGFDLTPYYGFQEDAVHWHTVARDLCLPFGEDVYPRYKKWCDDYFHLKHRNEQRGIGGLFFDDLNTPDFDHCFGFMQAVGKGFTDAYLPIVERRKAMAYGERERDFQLYRRGRYVEFNLVWDRGTLFGLQTGGRTESILMSMPPLVRWEYNYQPEEGSPEAALSEFIKVKDWLL

SEQ ID NO: 424 - protein, 299 aa, Trabulsiella
MKPDAQQVKTVLLTLQDTLCQQLSATDGSGFTEDLWQRAAGGGGRSRVLRNGGVFEQAGVNFSHVHGDAMPASATAHRPELVGRSFEAMGVSLVIHPHNPYVPTSHANVRFFIAEKPGADPVWWFGGGFDLTPFYGFNEDAVHWHTTARDLCLPFGDEVYPRYKKWCDDYFWLKHRNEQRGIGGLFFDDLNTPDFDHCFAFMQAVGNGFTDAYLPIVERRKMMPFGEREREFQLYRRGRYVEFNLVWDRGTLFGLQTGGRTESILMSMPPLVRWEYNYEPEKGSPEAALSEFLQVRDWI

SEQ ID NO: 425 - protein, 299 aa, Raoultella
MKPDAHQVKRYLLQLQETICQKLSAIDGGEFVEDSWQREGGGGGRSRVLRDGGVFEQAGVNFSHVHGDAMPASATAHRPELAGRSFEAMGVSLVVHPWNPYVPTSHANVRFFIAEKPGAEPVWWFGGGFDLTPFYGFEEDAVHWHRTAHDLCQPFGEEVYPRYKKWCDDYFYLKHRHEQRGIGGLFFDDLNTPDFDHAFAFMQAVGNGYTDAYLPIVEQRKAMPYGERERNFQLYRRGRYVEFNLVWDRGTLFGLQTGGRTESILMSMPPLVRWEYDYQPEEGSPEAALSEFIQVREWI

SEQ ID NO: 426 - protein, 299 aa, Kosakonia
MTPEIAPVKNALLALQDKICRQLSDIDGATFVEDAWQRAEGGGGRSRVLRDGGVFEQAGVNFSHVHGDAMPASATAHRPELAGRSFEAMGVSLVVHPRNPYVPTSHANVRFFIAQKPGADPVWWFGGGFDLTPYYGFEEDAIHWHRTARDICLPFGEEIYPRYKKWCDDYFYLKHRNEQRGIGGLFFDDLNTPDFDHCFAFMQAVGNGYLDAYLPIVARRKALPYGERERDFQLYRRGRYVEFNLVWDRGTLFGLQTGGRTESILMSMPPLVRWEYNYQPAEGSPEAALSEFIQVKDWV

SEQ ID NO: 427 - protein, 299 aa, Enterococcus
MKPDAAQVKTFLLQLQDNLCQQLSAVDGAPFIEDAWQREGGGGGRSRVLREGRVFEQAGVNFSHVHGDAMPASATAHRPELAGRSFEAMGVSLVVHPLNPYVPTSHANVRFFIAEKPGADPVWWFGGGFDLTPYYGFEEDAVHWHRTARDLCLPFGEEVYPRYKKWCDDYFYLKHRQEQRGIGGLFFDDLNTPDFDHCFAFMQAVGNGYADAYLPIVERRKATPYGERERHFQLYRRGRYVEFNLVWDRGTLFGLQTGGRTESILMSMPPLVRWEYDYQPEPGSPEAALSEFIQVRDWL

SEQ ID NO: 428 - protein, 307 aa, Unknown
  gamma proteobacterium
MNQLPDINQVKAFLLSLQDQICQKLSAVDGRAQFKQDQWVREEGGGGQSRVLTGGAIFEQAGVNFSHVSGATLPASATAHRPELAGRSFQAMGVSLVIHPLSPYIPTSHANVRFFIAEKPGEAPVWWFGGGFDLTPYYGFEEDARHWHQTAADLCQPFGDDVYPKYKKWCDDYFFIKHRNEARGIGGLFFDDLNSPDFAHCFAFMQAVANGFTDAYLPIVERRKTLTWGEREREFQLYRRGRYVEFNLVWDRGTLFGLQTGGRTESILMSMPPLVRWEYGFEPDENSPEAALYRDFLPVRDWLAESE

SEQ ID NO: 429 - protein, 303 aa, Shewanella
MKPDATQVKAFLLDLQQRICEGLEQLDGEAKFVADSWEREEGGGGTSRVLTKGKVFEQAGVNFSHVTGAAMPASATAHRPELAGRSFEAMGVSLVIHPNNPYVPTTHANVRFFIAEKEGADPVWWFGGGFDLTPYYPFEEDVVAWHQSAKALCEPFGEDVYPKYKKWCDEYFFLPHRNETRGVGGLFFDDLNEPGFENSFAFMQAVGEGFLKAYAPIVEKRKETAYGERERDFQLYRRGRYVEFNLVYDRGTLFGLQTGGRTESILMSMPPLVRWQYAYTPEAGSPEAKLYSDFLKPREWLEA

SEQ ID NO: 430 - protein, 302 aa, Oceanimonas
MSSKPDTSAVKAFLLALQDNICRQLEQADGSGRFIEDSWTREEGGGGRSRVLRNGTVIEQGGVNFSHVYGAAMPASATAHRPELAGRSFEAMGVSLVIHPHNPHVPTSHANVRFFIAEKEGAEPVWWFGGGFDLTPFYPVEEDCRHWHQVSKDLCEPFGEDVYPKYKEWCDRYFYLKHRNETRGVGGLFFDDLNEWPFERCFAFMKAVGEGYLDAYLPIIARRKDTPYGEDERQFQLYRRGRYVEFNLVYDRGTLFGLQTGGRTESILMSMPPLARWEYDWQPEAGSREARLQAFLVPRSWV

SEQ ID NO: 431 - protein, 302 aa, Chromobacterium
MSHPHSDAVKAILLDLQDRICAALEGADGDGRFVEDAWQREAGGGGRSRVLSNGAVFEQAGVNFSHVHGDALPASATAHRPELAGRRFEAMGVSLVIHPHNPHVPTSHANVRFFIAEKAGEAPVWWFGGGFDLTPFYPVREDVVHWHTVARDLCAPFGPEVYPRYKKWCDEYFYLKHRNEARGVGGLFFDDLNEWGFDQSFAFMQAVGNGYLDAYLPIVQARKDTAWGARERQFQLYRRGRYVEFNLVWDRGTLFGLQSGGRTESILMSMPPLVRWEYGYQPEPGSAEALLYTDFLPPRDWV

SEQ ID NO: 432 - protein, 302 aa, Pseudogulbenkiania
MSHPHSDAVKSFLLDLQDRICAALEQADGKAQFAEDAWSREAGGGGRSRVLAGGGVFEQAGVNFSHVHGDALPASATAHRPELADRRFEAMGVSLVIHPSNPHVPTSHANVRFFIAEKDGEAPVWWFGGGFDLTPYYPQEEDAVHWHTVARDLCAPFGGEVYPRYKKWCDEYFHLKHRNEARGIGGLFFDDLNEWGFDKSFAFTRAVGDGYLDAYLPIVARRKEQAWGDRERQFQLYRRGRYVEFNLVWDRGTLFGLQSGGRTESILMSMPPLVRWEYGYQPEPGSPEARLYTDFLPPRDWV

SEQ ID NO: 433 - protein, 302 aa, Chromobacterium
MSHPHSNAVKSFLLDLQDRICAALEQADGKAQFAEDAWSREAGGGGRSRVLTGGEVFEQAGVNFSHVHGDALPPSASAHRPELAGRRFEAMGVSLVIHPSNPHVPTSHANVRFFIAEKDGEAPVWWFGGGFDLTPFYPQEEDAVHWHTVARDLCAPFGGDVYPRYKKWCDEYFHLKHRNEARGIGGLFFDDLNEWGFDKSFAFTRAVGDGYLDAYLPIVARRKEQAWGDRERQFQLYRRGRYVEFNLVWDRGTLFGLQSGGRTESILMSMPPLVRWEYGYQPEPGSPEARLYTDFLPPRDWV

SEQ ID NO: 434 - protein, 302 aa, Aeromonas
MSKPDVAQVKAFLLQLQDEICRGLELADGVGHFVEDAWLREGGGGGRTRVLRHGAVIEQGGVNFSHVHGDAMPASATAHRPELAGRRFEAMGVSLVIHPHNPYVPTSHANVRFFIAEKEGEEPIWWFGGGFDLTPFYPFEEDVRHWHQVSRDLCQPFGTDIYPEFKSWCDRYFFLKHRDETRGVGGLFFDDLNRWPFADCFAFMQVVGKGYLDAYLPIVERRKALAYGEREREFQLYRRGRYVEFNLVYDRGTLFGLQTGGRTESILMSMPPLARWEYDWQPPAGSPEALLYSDYLKPREWL

SEQ ID NO: 435 - protein, 310 aa, Glaciecola
MNTELPSHEKIAQVKAFLLKLQDNICQTLELSDGKARFVEDEWEREQGGGGRTRVLTNGAVIEQGGVNFSHVFGDQMPASATAARPELAGRRFQAMGVSLVIHPHNPYIPTSHANVRFFIAEKEGEAPIWWFGGGFDLTPFFPFKEDVVHWHKVAHDLCLPFGEDVYPKYKKWCDDYFYLKHRNETRGVGGLFFDDLNTPDFETAFGFMQAVGNGYLDAYVPIIEKRKNTEYGNMERDFQLYRRGRYVEFNLVYDRGTLFGLQTGGRTESILMSMPPLVRWEYNYVPDEHSAQGKLAAYLTPQDWLAGQS

SEQ ID NO: 436 - protein, 304 aa, Alteromonas
MDGKNAAEVIEQVKSYLLGLQDTICQTLELADGKGQFVEDSWQREEGGGGRSRVLKNGAVIEQGGVNFSHVFGSQMPASATANRPELAGRNFQAMGVSLVIHPHNPYIPTSHANVRFFIAEKEGEAPIWWFGGGFDLTPFYPFKDDVVHWHDTAKKLCKPFGEDVYPKYKKWCDEYFYLKHRNETRGVGGLFFDDLNEWGFEQSFAFMQAVGNGFIDAYVPIVERRKQTDYGERERDFQLYRRGRYVEFNLVFDRGTLFGLQTGGRTESILMSMPPLARWEYCYTPAPGSAEAKLTDWLKPTPW

SEQ ID NO: 437 - protein, 305 aa, Gilvimarinus
MTTTPDKHAVKAYLMDLQERICDSLAAVDGGRFAEDTWQRAEGGGGRSRVLADGAVIEKGGVNFSHVMGDAMPASATAHRPELAGRSFEAMGVSLVIHPANPYAPTSHANVRFFIAEKEGADPVWWFGGGYDLTPFYGFVEDCVHWHKTAFEACAPFGDDVYPRYKNWCDEYFYLKHRNEARGVGGLFFDDLNELGFDQSFAFMRAVGDSYLQAYRPILERRKDSPYGEREREFQLYRRGRYVEFNLVYDRGTLFGLQTGGRTESILMSLPPLVRWEYDFHPEPDSPEARLSRDFLPHQDWLARQ

SEQ ID NO: 438 - DNA, 453 bp, Acinetobacter
atggatgcaccttctgatgctttcttatgggtaaaagcattacatattattgccgtagtatgttggtttgctgccttattctatttacctcgactctatgtttaccatgccatgagtgaggatgacactagtcatcgtcgttttgaagtcatggagcgtaaactttatcgtgggattatgtggccttctatgattgcgacactgatcactgctcattttttggtagattggggcgatgcaacacgacattatcatgaagcactctggttttatatcaaagtcggattggtgggacttttagttatctatcattttgtttgcggctactaccgtaaaaaactgattggcaatgcccattataaatcacacaaattctggcgttattttaatgaaatgccgacactgattttatttgcagtcgtgatcctggtcgtggtcaaaccacaattttaa

SEQ ID NO: 439 - DNA, 1365 bp, Calditerrivibrio
ttatttgtttaagagatttttaaatctatccacattcataaagcttgttctggtgcaatcatttatacccacaccatataagatattaccaccgataaaaatgtcatcaaattttttatagaactcttcaaccttttcaactattttgtggtgcccgatgtagtactgggggattgctttttcccatctaaaatattttattttgtaaggctctctttttatttttaaagtttcttttatgtcatcgaaagccatcctgataagttcatcgtcggatttttcaattatccatctatttttatctccacccattatcgttctaacgattttgtatccatcccttgttctatcagggaatatcgaagaatcaaacagtgctcccaaaattcttttattctctgaatggggtatcagatagccgaagccatccagaggatcttccagatcctccggcttgaatataaacccagcaacaaaaacaggagggtaagtgatgttatttagatccctggatagatctttatcaagaactgagagcatttgggaaacagcataggccggggcatttatgaatattttatcgaactccatgatgcctttattggtatttaatatatatctgtttatttttttatctattgaaaatacttccgtattcaacatctttgtgatgcttgtggattcgagtaaatctgttatcatattatccagtccatttttgtatgaagtaaggattccgccggggcctgatgggccactttttttcccttttttctttatcatccctttaaaaaggccaccataatttatttccagatcccttattacggggaaacaggatcttaagctcatcttttcgggatcacctgcaaaaatgccagagaccattgggctgataaggtattcaagagcttctttccccaatcttcttctggcaaagtctgccacagattcatcttcaaggacacttttttgtatgaaatattcggatagtatcctcatttttgctgagaaggagagtagcttagttttgaaaaacattggtggattttcaggtaatctatgtaaaatcccattgcgcatgatatatctttttcttgctaagtcattacttttgacaagattgttgcttaatcctgccattgatagaagttcaagggtatggggtttgctgtctaaaaaaccatttggccctgcttctactatgaacccatcttcccgtgaggtctctattgaaccgccccacctcaatctcttttctatgattgttatttccatatccagattcagttcatttttcaaattttccaataaaaaagcggtggatatccctgatattccgcctcctattatggctactctcat

SEQ ID NO: 440 - DNA, 1488 bp, Candidatus Legionella jeonii
atggcgacggaacagcacagcggcagcaggcgtatcgtggtggtggggagcggcatcgcgggtctggctgccgcctatcggctgcaggagcggtgcgagcaggacggcccgccttgcgaggtgcgcgtattggaggccgctgcacggcccggcggtgcgatcagtaccacgcaccgggatggttttgttcttgaatctgggcccgataccattttcaccgataagccgtggggattggatctgatcagacgcctcggtctgagcgagcaggtcatcgggaccaatgaggcgcaccgccggacctttgttgtgcgggacggcgcactgcacccgctgcccgaagggttcgccttgatggggccgaccaagccttggccgtttctgcaatcagggctgctgtcatggcgcggcaaggcaagggcggctctggacctggtactgccgcgagggggaccatccgacgacgagagcctggcgtcgttcgttcggcgtcgtttcggacaggagtttctcgatcggctggcccaaccgatgatcggtggaatctatggcgccgacccggagcggttgagtctgcgcgctaccttcccgcagtttctgcagatggaagcgacgcatcgcagcgtgatcctcggcctgcgacgaatgcgccccgccggccgcggcgtaggtcataccagcagcggcccgcgctatggcctgtttgtcacgctggatcacgggctgcaggccctcgtcgatgccatggtaaaaaggctgccggctgggacgctgcgtctccgcgcgccggttgatagaatcgcgcacacagagcaaggctggaccgttcgacttggagacggcgcgagcctgcaggccgatggccttattctcgccgtccccgcatttgagattgccaggcttacccacgacctggaccaagacctggctcgtcagctcgaggccatgccctacgcctcttcggtcacgatcaatctggcctatcgtagagaggcgatccaccatccgctcgacgggtttggatttgtggtgccggcctgcgaggggcgcaccatcattgcctgttcgttcagcagcgtgaagttcgctcatcgggcgccggccggtcacgtcctgctgcgtgccttcgcgggcggcgcgctgcagccggagccgttcacctgggatgacgagacgctgctgagcgcagtgcgccgcgatctggaggagctgctggcgattcacgcgccgcctttgtggagccagttggtccgacatcctcgtgtgatgccccagtaccaggtcggccacctgggccggttggcggcgctcgaagagacgcttcggcggtggccgaccctcaagctgaccggtaacgcctacagaggtgtcggtgtgccggatgtggttcacagcggggagacggccgccgattcattattggcagagctggccccgtcaccgaccgagccgacccccgcttgtaccgaaggcgattctcgcctataa

SEQ ID NO: 441 - DNA, 1425 bp, Chloroflexus
atgatggcgggatacgacagtgtagtgattggcggtggcattgccggtttagctgcggcttacacgctccacaagcgtggttatcgggtcctggtcatcgagtcgaccaatcgcgttggcggtgtgatccagaccatcaccacaccagaaggctacattctcgattgtgggccgaacacggtgggtaccggcgatgcgcgattgtggcaggaactgatcgatctgggtctgcgcgagcggatcacaccggcagcgccatgtagcaaacggcggttcatcctgatcaatggtacaccggttgaaatcccaacctcaccagtcgggctgattaccacgcgattactctcgtggcgggggaaattgcgggtactggccgaaccgttcatcaaccgtggatcgaccgatcccgatgaaagcgttgctgccttcttcacccgccggattggtgcagaggctaccgcccacctcctcgatccatttgttgccggcgtctacgctggcgatccgcaacggctctcgactgcggcagtctttccatcactgtgggaagcggcccagcgcagtggcagcatcgtgcgcggcatgctgagcaaacccaaaccgaagactcaggtgagtgagccaaagatgcgcagccgcacctttaccttccgcggtggcctggccgaatggccacgcgctctggcgcaagccctgggtgccggcaatgtctggacagaacggcgcgtggtcaagctccaaccacgcgactcctggtgggaagtgacgattgatggtgtgaacggcccggagacactcatcagtcgcagcctcattatcgccaccccagcctttacggcggctgatctcattgagtcggttgatcaaagagcggctggtgccctacgcggcattccgtatgcgccggtagcagtggtacatctcggctttcgtcgtgaccagatcagccaggaattgagcggctttggtgtgctggccccctcaagcgaacagcgtcagttcctcggcattctctggacatcaagcatcttcccgcacgttgcaccacacgatcatgtcctcaccacaaccctcagtggtggtgctatccggcccgaactggccgaacggagtgacgaaacactgattgaagcggccattcgcgatcatcaccagctcctggggatcagagggcaaccgatcttcacccatgttactcgctggcgaaccgccattgcccagtatacctttgggcaccgcgagcggattgccaccctcgtgcaactcgaacagcgcctgccgaccatccagtttgccggcagctaccgcgacggcgttggagtgcccaaaacctgggccagcggtgtgcaggcaggcgagcggatcgctgcggcactggcagcccatggaactaccgcagtttccacagagacggcgtcggggtga

SEQ ID NO: 442 - DNA, 546 bp, Escherichia
gtgaaaacattaattcttttctcaacaagggacggacaaacgcgcgagattgcctcctacctggcttcggaactgaaagaactggggatccaggcggatgtcgccaatgtgcaccgcattgaagaaccacagtgggaaaactatgaccgtgtggtcattggtgcttctattcgctatggtcactaccattcagcgttccaggaatttgtcaaaaaacatgcgacgcggctgaattcgatgccgagcgccttttactccgtgaatctggtggcgcgcaaaccggagaagcgtactccacagaccaacagctacgcgcgcaagtttctgatgaactcgcaatggcgtcccgatcgctgcgcggtcattgccggggcgctgcgttacccacgttatcgctggtacgaccgttttatgatcaagctgattatgaagatgtcaggcggtgaaacggatacgcgcaaagaagttgtctataccgattgggagcaggtggcgaatttcgcccgagaaatcgcccatttaaccgacaaaccgacgctgaaataa

SEQ ID NO: 443 - DNA, 900 bp, Escherichia
atgaaacccgacgcacaccaggttaaacagtttctgctcaaccttcaggatacgatttgtcagcagctgaccgccgtcgatggcgcagaatttgtcgaagatagttggcagcgcgaagctggcggcggcgggcgtagtcgggtgttgcgtaatggtggtgttttcgaacaggcaggcgtcaacttttcgcatgtccacggtgaggcgatgcctgcttccgccaccgctcatcgcccggaacttgccgggcgcagtttcgaggcgatgggcgtttcactggtagtgcatccgcataacccgtatgttcccaccagccacgcgaatgtgcggttttttattgccgaaaaaccgggtgccgatcccgtctggtggtttggcggtggcttcgacttaaccccattctatggttttgaagaagatgctattcactggcatcgcaccgcccgtgacctgtgcctgccatttggcgaagacgtttatccccgttacaaaaagtggtgcgacgaatacttctacctcaaacatcgcaacgaacagcgcggtattggcgggctgttctttgatgacctgaacacgccagatttcgaccgctgttttgcctttatgcaggcggtaggcaaaggctacaccgacgcttatttaccaattgtcgagcgacggaaagcgatggcctacggcgagcgcgagcgcaatttccagttatatcgtcgcggtcgttatgtcgagttcaatctggtctgggatcgcggcacgctgtttggcctgcaaactggcgggcgcaccgagtctatcctgatgtcaatgccgccactggtacgctgggaatatgattatcagccaaaagatggcagcccagaagcggcgttaagtgagtttattaaggtcagggattgggtgtaa

SEQ ID NO: 444 - DNA, 1326 bp, Hydrogenobacter
atgatagatgtagcggtagtaggggcaggtatatccgggctatccatagcctatcaccttaaaaaggctggacttgaggtaaaggtttttgaaaaagaagatgccgtaggtggaaacatacaaacagcatacatagacggttatgtttgcgagcttggacctcagaccattcttgcggacagtaaagtagaagagtttttaaaagatgcaggtataaagcccatatatgccaatccttcttccaaaaagagatacatatacaggaagggtaagttggtggctcttcctctatcacccgtagaatttctcttatcaccttttctgtccctcggcggaaagctaagagtcctcaaagagccttttgttccaaggtctcccaagcaggaagaaagtatagcggagtttgtcagaaggcgttttgggagggagtttttagattatgtagtagctcctttcgtgtctggagtttacgctggagacccagaggagctatctgttaaatacgcagttagaaaggtttacgagctggagcaaaagtacggaagcgttataaagggagccataaagctcaaagctcttggtccatcgggaaagctcatatcctttgaaggaggaaatgcaactcttataagaaagctctctgaaagtttagaggttcataaagagaatgtggttctgaggataaggagaaaggacgatatttttatcctagataccaaggaggggaaggttacggctaaggcggttgtagtttctactcctgccacatctacaggttatctgctcagggatctgtcttggagcatatccgaggagtttgacaaaatatactacgctcctgttctggtggtgcatgtggcagtaaagtttggtgttctgccagaaggctttggttttttagtgccaaaaaaggaaaacaaaaggatactgggggtgatcttttcatctaatctttttgaaggaaggagtccagagggcaagagtcttatcaccgtatatattggtggtgccacagacccagaaataatagaatacgaagatgaagccattgtaagtgtgctggagagggaactaagagagaccgtagatataagagactgggatcttttaaaaataacgcgctggaaaaagggtataccccaatacactgtggggtacggaaggtatcttgagctggcaaactccatagagatggagcaacccggacttttcttgagtggcaattatctttatggtgtttccgttgcagactgtataagagtttcacatcacatagcaaagagggtaatagactttttggaagttaaggggcgtactgttgtataa

SEQ ID NO: 445 - DNA, 1323 bp, Laribacter
tcagctggccggcgggtagtccagcaagcactggacagccacctgctgccccttgtcgagacagtcgacgaccgataccccgccatgccagttggcacacacgcggataccgtgttcatgcaggtcactgaccgcgctggccagcggcagggcatggctgtcgtactgcggaatggcctgctcctgacgggtcagccggcaaagggtcggctcgccctggatgcggtagagccgccgcagttcttccagcgccagcgccaccagcgtggcgtcatcgtgccggtaacggtcaaggaactgcatgccgccgacaaaggtggtcagcagggtttcgcctgccggcgtgcggtcgggaaacagcgagccggaccagatggagccggcggcaaacggtttttcgactttggggttcagcccgccaaaaccgtcgaggtcatgcccgaccgtgctgcgtggccaggccgtatgcaggacggccaccggggcgtaggttacgttggcaaggttcgctgcaatggccggaaaatggctggccagcagttgcccggccacgtcggccggcacggccagcaccacttcgtcggcgtccagttcacctgctggggttctgacccgccagccggtttccagccgctccagtgcctgcaccgacgtatccagccgtacgtccagcccctgcgccagcgtttcgggcagctgctgcaaaccctcgttcagggtgaaggtggccttgcgccggaaggttttgcggcgggcaaacatgccgcgcacgatggagcctgactggcgctcggcttcgtggatgaccggcagcgtcagtccggccaccagctcttcgggatcaccggcaaaaatgccgccgacaaacggcgaaatggcccgctcgacaaattcgtcgcccagacgacgccggaaaaaggcagccacggtttccggctcacgcaccggccggttgcgccggaaaggctcggtcagcgccagccatttgctccgggcaccgaactgcgatccggtcaggaacgacagcggtccggacggcagggcctcgtagcgatcgccgcgcagcacgaaacggtgccggaccacggccgccgccggccggatggctgccgtgaggcccagccgttccagaaggtccagatgcccggcatggccgtaaagggtattggggccgagttccagccggtaaccgtcggccgctaccgtcccgatcttgccgccgacccggctgccggcctccagcaccacgacggggatgccccgctgttgcaggtgccaggcacacgacaggccggaaatgccggcaccgatcaccaccaccat

SEQ ID NO: 446 - DNA, 1404 bp, Opitutus
ctattgcccggcgcgttccgccagtttttcgccggccgcgatgcaggccgggacggcgatcccgtcgcgggcctgtccccccatgaacagtcccggatggaagcgttcgccggcggcaagagcggcgatgaagtgctcgtgaccgaggttgtactgcgggatggcgcgaggccagaagttgtgccggacaaaaaccgggtcgccgctgacgccgagcaactgcgtgagatcgggccgcacggcggcaagcagctgatcggcgggcaggctggcgagttgcggctggcgtgttccgcccaccatcaccgtcagcgccacgtgtcccagcggcgcgcggcccgggaacagcgaggacgagaacagcacgccaaggaccgagcgcttctcgacggccggcacgagcacgccgaacccgtcgagcggatgcgcgacctgctcgcggcggaagccgaggaagagcgacgagaccggcgggtgttcgatcagcgccagcgcggcgagcggcttttcgccgagcgtgccgatctggagtcgcgcgagggcgggcgcgggcagcgcgaccacgacgctgtcgaagctttgcgtgtgcgtcgccacgtcgtcgtgccaaaccacgttccacttgtcgccgggcacgatggcgtcgagcgaagcgccgagtgtgatggcgccggcggggagacgcgcggcgagcgcctccggcagcacgtgcaggccgtgtttgaaggaaaagatgccggggcgcggctcaccgcgggccttccgggctttggccgcggcgatctggccgcggatcagcgagccgtgggtttgttcgatttcccagagcttggggaacgactgccgcgcggagagcttttcgggatcgccggcatacacgccgcccacgaacggattgagcgcgtagtcgacgaactcgcgcccgaagtgcgactcgacgaattcggcgaggctgacgtcggtcgtgcggacgcgccgccgggcgaacagctcggcgaggagcttgaacttggcgacgggcgaaaacagtgaggaggcgaagaacgacggtggggacatcggcgcggccagcgcgcggccgcggcgaacgatgtagcggtttttcgcggcgggatccgcggcgatgcgttcgccgttcagcccgagttcgtcgatgagcttgtcgacggcgagttcgccggagagcagcgtgttgggtccgccttcgatcagccagccgtcgacttcctccgtcttgatcgagccgccgacgcggtcggattgctcgaacacgcgcaccttgtggccgagctgggtgagccggtgggcggcggtgagcccggtgatgccggcgccaagcacggcgaacgttttgggcggccggcctgaggcggtggcggaaggattaaaaggcgaggtgctcat

SEQ ID NO: 447 - DNA, 1410 bp, Rhodothermus
atggcttctgtgggaatcatcggagccggcattgccggtctgacggccgcctacgaactgcaccgtcgtggcctggaagtgacggtctttgaagccaccgaccgcatcggcggcttcattcagtcggagcggatcgacggctttctggtggagctcggtcctcagacgctccagcgcacctcgggcgacttcgaagagttgctgcgacaggtggatctggaggacgcgtgcattccggcccgaccggtcgcggcgaatcgcttcatcgtgcggggtggccagccgatacccctgccacgctcgccgcgcgaactgctgcgcacgccgctgctttcgccccgggcgcgcctgcgcctgctggccgagccgttcattcaccgggcccaccggagcaccgaggaaagcgtggccaaattcacccggcgtcgactgggtccggaggtgctcgactatctggtagagcccttcgtggccggcatctttgcgggcgatcccgagcagctttcggtgcgctacgccttcccgaaactgttcgaactggagcagcagtacggctcgcttttctggggcctgatccgcgatcggatgaagcagcggtatcatccggccccgcgccgctcgatgttctcgtttgtcgagggcctgcacatgctgccccgggcgctggccgagcggttgcccgcgcacgcgatcgtgcgcaacgcggaggtgctggccatccgctgggacgagaaaaacccctggacgctcacgttccggcagcacggccgcgcttcgacccgttttttcgatatcatcgtctgtgccgtgccgctacaccggctggcgcaactccggattcatcccccggtggatcgccggccgctcagcaccgtcgagcacccgcccattgcgctggtggcgctgggcttccggcgcgagcaggtggcccatccgctggacggcttcgggatgctggtaccggccgtggagcgcgactttcagattctgggcacgctgttctcctcgtcgctctttccggaccgggcgcccgaaggccacgtgctgctgaccacgttcgtcggcggcatgcggcatcccgaactggcgttgctgcccgaagatcggctggaggcgctggtgctgcaggacctgcgccggctgctgggcatctcgggcgcgccggtcttccggcacgtgtggcgctgggagcgctcgatcccgcagtaccggctgggctacgatgcggtgctcgcctgcgttcacgatgtggaaatgagccgctccggtctgtttctggccggcaactacatggaaggcatctccgtgatcgacgcgctccataccggcctgaaggccgcccgcgcgatcatccagcacctgcgcgaagaagcagccggcggtctggccaagctggtgctgggagattga

SEQ ID NO: 448 - protein, 179 aa, Enterobacter cloacae [sequence omitted]

SEQ ID NO: 449 - protein, 178 aa, Pantoea ananatis
MKALILFSTRDGQTQKIASAIADEIKGQQSCDVINIQDAKTLDWQQYDRVLIGASIRYGHFQPVVNEFVKHNLLALQQRVSGFFSVNLTARKPEKRSPETNAYTVKFLAQSPWQPDCCAVFAGALYYPRYRWFDRVMIQFIMRMTGGETDASKEVEYTDWQQVQRFARDFAQLPGKSY

SEQ ID NO: 450 - protein, 177 aa, Pantoea stewartii
MKALILYSTRDGQTRKIASSIADVIRQQQQCDVLNIKDASLPDWAQYDRVLIGASIRYGHFQPVVDKFVKQHLHELQQRTSGFFSVNLTARKPEKRSPETNAYTQKFLAHSPWQPDCCAVFAGALYYPRYRWFDRVMIQLIMRMTGGETDSTKEVEYTDWQQVSTFANDFAQLPGKS

SEQ ID NO: 451 - protein, 181 aa, Escherichia coli; identical to SEQ ID NO: 320

SEQ ID NO: 452 - protein, 178 aa, Erwinia toletana
MKALILFSSREGQTREIASYIANSIKEEMECDVFNILRVEQIDWSQYDRVLIGGSIHYGHFHPAVAKFVKRHLHELQQRSSGFFCVNLTARKADKRTPQTNAYMRKFLLQSPWQPDCCAVFAGALRYTRYRWFDRVMIQLIMRMTGGETDTSKEVEYTDWTQVARFAQEFAHLPGKTQ

SEQ ID NO: 453 - protein, 179 aa, Pectobacterium carotovorum
MKALIVFSSRDGQTRAIASYIANTLKGTLECDVVNVLNANDIDLSQYDRVAIGASIRYGRFHPAVNQFIRKHLTSLQQLPSAFFSVNLTARKPEKRTIQTNAYTRKFLLNSPWQPDLCCVFAGALRYPRYRWFDRVMIQLIMRITGGETDSTKEIEYTDWQQVARFAQDFAQLAAKNPA

SEQ ID NO: 454 - protein, 179 aa, Shimwellia blattae
MKTLILFSTRDGQTHKIARHIAGVLEEQGKACELVDLLQPGEPDWSTVECVVLGASIRYGHFHKSFIRFVNTHAQRLNNMPGALFTVNLVARKPEKQSPQTNSYTRKFLAASPWQPQRCQVFAGALRYPRYSWYDRMMIRLIMKMAGGETDTRKEVEYTDWQSVTRFAREIAQLPGETR

SEQ ID NO: 455 - protein, 178 aa, Pantoea stewartii
MKALILFSSRDGQTQLIASSIAKELEGKQACDVLNILDTTNVEWTQYDRVLIGASIRYGHFHPAVAEFVKRHQRELQQRSSGFFSVNLTARKPEKRSPETNAYTAKFLNQSPWQPDCCAVFAGALRYPRYRWFDRIMIQLIMRMTGGETDSSKEVEYTDWQQVTRFAQEFARLPGKTS

SEQ ID NO: 456 - protein, 180 aa, Enterobacter cloacae
MKTLILFSTRDGQTREIAAFLASELKEQGIYADVINLNRTEEIAWQEYDRVVIGASIRYGHFHPAVDRFVKKHTETLNSLPGAFFSVNLVARKAEKRTPQTNSYTRKFLLNSPWKPAACAVFAGALRYPRYRWYDRFMIRLIMKMTGGETDTRKEVVYTDWSQVASFAREIVQLTRSSRL

SEQ ID NO: 457 - protein, 177 aa, Enterobacter mori
MKILILFSTRDGQTREIAASLASELKEQAFDVDVVNLHRAENIAWEEYDGVVIGASIRYGHFHSTLNSFVKKHQQALKKLPGAFYSVNLVARKPEKRTPQTNSYTRKFLLDSPWQPDLSAVFAGALRYPRYNWYDRIMIRLIMKITGGETDTRKEVVYTDWQQVTHFAHEIVQLVRK

SEQ ID NO: 458 - protein, 178 aa, Enterobacter cloacae
KALVLYSTRDGQTHAIASYIASCMKEKAECDVIDLTHGEHVNLTQYDQVLIGASIRYGHFNAVLDKFIKRNVDQLNNMPSAFFCVNLTARKPEKRTPQTNPYVRKFLLATPWQPALCGVFAGALRYPRYRWIDKVMIQLIMRMTGGETDTSKEVEYTDWEQVKKFAEDFAKLSYKKAL

SEQ ID NO: 459 - protein, 177 aa, Pantoea ananatis
KALILFSTRDGQTQKIASAIADEIKGQQSCDVINIQDAKTLDWQQYDRVLIGASIRYGHFQPVVNEFVKHNLLALQQRVSGFFSVNLTARKPEKRSPETNAYTVKFLAQSPWQPDCCAVFAGALYYPRYRWFDRVMIQFIMRMTGGETDASKEVEYTDWQQVQRFARDFAQLPGKSY

SEQ ID NO: 460 - protein, 180 aa, Escherichia coli
KTLILFSTRDGQTREIASYLASELKELGIQADVANVHRIEEPQWENYDRVVIGASIRYGHYHSAFQEFVKKHATRLNSMPSAFYSVNLVARKPEKRTPQTNSYARKFLMNSQWRPDRCAVIAGALRYPRYRWYDRFMIKLIMKMSGGETDTRKEVVYTDWEQVANFAREIAHLTDKPTLK

SEQ ID NO: 461 - protein, 177 aa, Erwinia toletana
KALILFSSREGQTREIASYIANSIKEEMECDVFNILRVEQIDWSQYDRVLIGGSIHYGHFHPAVAKFVKRHLHELQQRSSGFFCVNLTARKADKRTPQTNAYMRKFLLQSPWQPDCCAVFAGALRYTRYRWFDRVMIQLIMRMTGGETDTSKEVEYTDWTQVARFAQEFAHLPGKTQ

SEQ ID NO: 462 - protein, 178 aa, Pectobacterium carotovorum
KALIVFSSRDGQTRAIASYIANTLKGTLECDVVNVLNANDIDLSQYDRVAIGASIRYGRFHPAVNQFIRKHLTSLQQLPSAFFSVNLTARKPEKRTIQTNAYTRKFLLNSPWQPDLCCVFAGALRYPRYRWFDRVMIQLIMRITGGETDSTKEIEYTDWQQVARFAQDFAQLAAKNPA

SEQ ID NO: 463 - protein, 178 aa, Shimwellia blattae
KTLILFSTRDGQTHKIARHIAGVLEEQGKACELVDLLQPGEPDWSTVECVVLGASIRYGHFHKSFIRFVNTHAQRLNNMPGALFTVNLVARKPEKQSPQTNSYTRKFLAASPWQPQRCQVFAGALRYPRYSWYDRMMIRLIMKMAGGETDTRKEVEYTDWQSVTRFAREIAQLPGETR

SEQ ID NO: 464 - protein, 179 aa, Enterobacter cloacae
KTLILFSTRDGQTREIAAFLASELKEQGIYADVINLNRTEEIAWQEYDRVVIGASIRYGHFHPAVDRFVKKHTETLNSLPGAFFSVNLVARKAEKRTPQTNSYTRKFLLNSPWKPAACAVFAGALRYPRYRWYDRFMIRLIMKMTGGETDTRKEVVYTDWSQVASFAREIVQLTRSSRL

SEQ ID NO: 465 - protein, 178 aa, Artificial Sequence
  Recombinant
KALVLYSTRDGQTHAIASYIASCMKEKAECDVIDLTHGEHVNLTQYDQVLIGANIRYGHFNAVLDKFIKRNVDQLNNMPSAFFCVNLTARKPEKRTPQTNPYVRKFLLATPWQPALCGVFAGALRYPRYRWIDKVMIQLIMRMTGGETDTSKEVEYTDWEQVKKFAEDFAKLSYKKAL

SEQ ID NO: 466 - protein, 172 aa, Artificial Sequence
  Recombinant
KALVLYSTRDGQTHAIASYIASCMKEKAECDVIDLTHGEHVNLTQYDQVLIGASIRYGHFNAVLDKFIKRNVDQLNNMPSAFFCVNLTARKPEKRTPQTNPYVRKFLLATPWQPALCGVFAGALRYPRYRWIDKVMIQLIMRMTGGETDTSKEVEYTDWEQVKKFAEDFAKL

SEQ ID NO: 467 - protein, 179 aa, Artificial Sequence
  Recombinant
KTLILFSTRDGQTREIAAFLASELKEQGIYADVINLNRTEEIAWQEYDRVVIGASIRYGHFHPAVDRFVKKHTETLNSLPGAFFSVNLVARKAEKRTPQTNSYTRKFLLNSPWKPAACAVFAGALRYPRYRWYDRFMIRLIMKMTGGETDTRKEVVYTDWSQIASFAREIVQLTRSSRL

SEQ ID NO: 468 - protein, 504 aa, Amaranthus tuberculatus
MGNISEREEPTSAKRVAVVGAGVSGLAAAYKLKSHGLSVTLFEADSRAGGKLKTVKKDGFIWDEGANTMTESEAEVSSLIDDLGLREKQQLPISQNKRYIARDGLPVLLPSNPAALLTSNILSAKSKLQIMLEPFLWRKHNATELSDEHVQESVGEFFERHFGKEFVDYVIDPFVAGTCGGDPQSLSMHHTFPEVWNIEKRFGSVFAGLIQSTLLSKKEKGGENASIKKPRVRGSFSFQGGMQTLVDTMCKQLGEDELKLQCEVLSLSYNQKGIPSLGNWSVSSMSNNTSEDQSYDAVVVTAPIRNVKEMKIMKFGNPFSLDFIPEVTYVPLSVMITAFKKDKVKRPLEGFGVLIPSKEQHNGLKTLGTLFSSMMFPDRAPSDMCLFTTFVGGSRNRKLANASTDELKQIVSSDLQQLLGTEDEPSFVNHLFWSNAFPLYGHNYDSVLRAIDKMEKDLPGFFYAGNHKGGLSVGKAMASGCKAAELVISYLDSHIYVKMDEKTA

SEQ ID NO: 469 - DNA, 537 bp, Artificial Sequence
  Recombinant
atgaaagcgctggtgctgtatagcacccgcgatggccagacccatgcgattgcgagctatattgcgagctgcatgaaagaaaaagcggaatgcgatgtgattgatctgacccatggcgaacatgtgaacctgacccagtatgatcaggtgctgattggcgcgagcattcgctatggccattttaacgcggtgctggataaatttattaaacgcaacgtggatcagctgaacaacatgccgagcgcgtttttttgcgtgaacctgaccgcgcgcaaaccggaaaaacgcaccccgcagaccaacccgtatgtgcgcaaatttctgctggcgaccccgtggcagccggcgctgtgcggcgtgtttgcgggcgcgctgcgctatccgcgctatcgctggattgataaagtgatgattcagctgattatgcgcatgaccggcggcgaaaccgataccagcaaagaagtggaatataccgattgggaacaggtgaaaaaatttgcggaagattttgcgaaactgagctataaaaaagcgctg

SEQ ID NO: 470 - DNA, 534 bp, Artificial Sequence
  Recombinant
atgaaagcgctgattctgtttagcacccgcgatggccagacccagaaaattgcgagcgcgattgcggatgaaattaaaggccagcagagctgcgatgtgattaacattcaggatgcgaaaaccctggattggcagcagtatgatcgcgtgctgattggcgcgagcattcgctatggccattttcagccggtggtgaacgaatttgtgaaacataacctgctggcgctgcagcagcgcgtgagcggcttttttagcgtgaacctgaccgcgcgcaaaccggaaaaacgcagcccggaaaccaacgcgtataccgtgaaatttctggcgcagagcccgtggcagccggattgctgcgcggtgtttgcgggcgcgctgtattatccgcgctatcgctggtttgatcgcgtgatgattcagtttattatgcgcatgaccggcggcgaaaccgatgcgagcaaagaagtggaatataccgattggcagcaggtgcagcgctttgcgcgcgattttgcgcagctgccgggcaaaagctat

SEQ ID NO: 471 - DNA, 531 bp, Artificial Sequence
  Recombinant
atgaaagcgctgattctgtatagcacccgcgatggccagacccgcaaaattgcgagcagcattgcggatgtgattcgccagcagcagcagtgcgatgtgctgaacattaaagatgcgagcctgccggattgggcgcagtatgatcgcgtgctgattggcgcgagcattcgctatggccattttcagccggtggtggataaatttgtgaaacagcatctgcatgaactgcagcagcgcaccagcggcttttttagcgtgaacctgaccgcgcgcaaaccggaaaaacgcagcccggaaaccaacgcgtatacccagaaatttctggcgcatagcccgtggcagccggattgctgcgcggtgtttgcgggcgcgctgtattatccgcgctatcgctggtttgatcgcgtgatgattcagctgattatgcgcatgaccggcggcgaaaccgatagcaccaaagaagtggaatataccgattggcagcaggtgagcacctttgcgaacgattttgcgcagctgccgggcaaaagc

SEQ ID NO: 472 - DNA, 546 bp, Escherichia coli; identical to SEQ ID NO: 442

SEQ ID NO: 473 - DNA, 534 bp, Artificial Sequence
  Recombinant
atgaaagcgctgattctgtttagcagccgcgaaggccagacccgcgaaattgcgagctatattgcgaacagcattaaagaagaaatggaatgcgatgtgtttaacattctgcgcgtggaacagattgattggagccagtatgatcgcgtgctgattggcggcagcattcattatggccattttcatccggcggtggcgaaatttgtgaaacgccatctgcatgaactgcagcagcgcagcagcggctttttttgcgtgaacctgaccgcgcgcaaagcggataaacgcaccccgcagaccaacgcgtatatgcgcaaatttctgctgcagagcccgtggcagccggattgctgcgcggtgtttgcgggcgcgctgcgctatacccgctatcgctggtttgatcgcgtgatgattcagctgattatgcgcatgaccggcggcgaaaccgataccagcaaagaagtggaatataccgattggacccaggtggcgcgctttgcgcaggaatttgcgcatctgccgggcaaaacccag

SEQ ID NO: 474 - DNA, 537 bp, Artificial Sequence
  Recombinant
atgaaagcgctgattgtgtttagcagccgcgatggccagacccgcgcgattgcgagctatattgcgaacaccctgaaaggcaccctggaatgcgatgtggtgaacgtgctgaacgcgaacgatattgatctgagccagtatgatcgcgtggcgattggcgcgagcattcgctatggccgctttcatccggcggtgaaccagtttattcgcaaacatctgaccagcctgcagcagctgccgagcgcgttttttagcgtgaacctgaccgcgcgcaaaccggaaaaacgcaccattcagaccaacgcgtatacccgcaaatttctgctgaacagcccgtggcagccggatctgtgctgcgtgtttgcgggcgcgctgcgctatccgcgctatcgctggtttgatcgcgtgatgattcagctgattatgcgcattaccggcggcgaaaccgatagcaccaaagaaattgaatataccgattggcagcaggtggcgcgctttgcgcaggattttgcgcagctggcggcgaaaaacccggcg

SEQ ID NO: 475 - DNA, 537 bp, Artificial Sequence
  Recombinant
atgaagaccttgatcctattctccaccagggacggccaaacacacaagatcgcaaggcacatcgcaggagtcctcgaagagcaggggaaggcctgcgagttggtcgatctgttacagcccggcgaaccagactggagtaccgttgaatgcgtcgttctaggggccagcattagatatggtcacttccataagtctttcatcaggttcgtaaacactcacgcgcagcgcttgaataatatgccaggcgcccttttcacagttaacttagtcgcccgaaagcccgagaagcagagtccacagacgaactcttacacccgcaagtttctcgccgcctccccttggcagccacagcgatgccaagttttcgcgggcgctttgaggtaccctaggtactcgtggtacgacagaatgatgatacgtttgataatgaagatggccgggggcgagactgacacaaggaaggaggttgagtacactgactggcagtcggtgactcggttcgcgagggagatcgctcagctgccgggagagacgcgg

SEQ ID NO: 476 - DNA, 534 bp, Artificial Sequence
  Recombinant
atgaaagcgctgattctgtttagcagccgcgatggccagacccagctgattgcgagcagcattgcgaaagaactggaaggcaaacaggcgtgcgatgtgctgaacattctggataccaccaacgtggaatggacccagtatgatcgcgtgctgattggcgcgagcattcgctatggccattttcatccggcggtggcggaatttgtgaaacgccatcagcgcgaactgcagcagcgcagcagcggcttttttagcgtgaacctgaccgcgcgcaaaccggaaaaacgcagcccggaaaccaacgcgtataccgcgaaatttctgaaccagagcccgtggcagccggattgctgcgcggtgtttgcgggcgcgctgcgctatccgcgctatcgctggtttgatcgcattatgattcagctgattatgcgcatgaccggcggcgaaaccgatagcagcaaagaagtggaatataccgattggcagcaggtgacccgctttgcgcaggaatttgcgcgcctgccgggcaaaaccagc

SEQ ID NO: 477 - DNA, 540 bp, Artificial Sequence
  Recombinant
atgaaaaccctgattctgtttagcacccgcgatggccagacccgcgaaattgcggcgtttctggcgagcgaactgaaagaacagggcatttatgcggatgtgattaacctgaaccgcaccgaagaaattgcgtggcaggaatatgatcgcgtggtgattggcgcgagcattcgctatggccattttcatccggcggtggatcgctttgtgaaaaaacataccgaaaccctgaacagcctgccgggcgcgttttttagcgtgaacctggtggcgcgcaaagcggaaaaacgcaccccgcagaccaacagctatacccgcaaatttctgctgaacagcccgtggaaaccggcggcgtgcgcggtgtttgcgggcgcgctgcgctatccgcgctatcgctggtatgatcgctttatgattcgcctgattatgaaaatgaccggcggcgaaaccgatacccgcaaagaagtggtgtataccgattggagccaggtggcgagctttgcgcgcgaaattgtgcagctgacccgcagcagccgcctg

SEQ ID NO: 478 - DNA, 531 bp, Artificial Sequence
  Recombinant
atgaaaattctgattctgtttagcacccgcgatggccagacccgcgaaattgcggcgagcctggcgagcgaactgaaagaacaggcgtttgatgtggatgtggtgaacctgcatcgcgcggaaaacattgcgtgggaagaatatgatggcgtggtgattggcgcgagcattcgctatggccattttcatagcaccctgaacagctttgtgaaaaaacatcagcaggcgctgaaaaaactgccgggcgcgttttatagcgtgaacctggtggcgcgcaaaccggaaaaacgcaccccgcagaccaacagctatacccgcaaatttctgctggatagcccgtggcagccggatctgagcgcggtgtttgcgggcgcgctgcgctatccgcgctataactggtatgatcgcattatgattcgcctgattatgaaaattaccggcggcgaaaccgatacccgcaaagaagtggtgtataccgattggcagcaggtgacccattttgcgcatgaaattgtgcagctggtgcgcaaa

SEQ ID NO: 479 - DNA, 540 bp, Artificial Sequence
  Recombinant
atgaaggccttggtactgtactcgacgcgggacggccagacccacgcaattgcttcatacatcgcctcctgcatgaaggagaaggccgaatgcgacgtgatcgacctcacccacggggagcacgtgaacctcacccaatacgatcaggtgctaatcggtgcgagtattcgttacggccacttcaacgccgtgcttgacaagttcatcaagagaaacgtggatcagctgaacaacatgccaagcgcgttcttctgcgtaaacctcacagcaaggaagcccgagaagcgtactccccagacaaacccttatgtccgaaaattcttgcttgctaccccctggcagcccgcgttgtgcggagtgttcgcaggggcccttcggtacccgcgataccggtggatcgacaaggtgatgatccagctaataatgcggatgactgggggagagacagacacgagcaaggaggtcgagtacacggattgggagcaggttaagaagttcgcggaggattttgcaaagctatcgtacaagaaggccctctag

SEQ ID NO: 480 - DNA, 537 bp, Artificial Sequence
  Recombinant
atgaaggccttgatcctgttctctacacgcgacggacagacacagaagatcgcatctgccatcgctgatgagataaaggggcagcaatcgtgcgacgtgattaacatacaggatgccaaaaccctcgactggcagcagtacgaccgggtactcatcggcgcctccattcgttacgggcatttccagcccgttgtgaatgagtttgtcaagcacaacctcttggccctacagcagagagtttccggattcttctccgtgaacttgacagcccgaaagccagagaagcggagccccgagactaacgcttatacagtcaaattcttggcgcagtcaccctggcaaccggactgctgcgctgtttttgcgggggccctgtactacccacggtaccggtggttcgatagggtgatgatacagttcataatgcgaatgacggggggagagaccgacgcatcgaaagaggtggagtacactgactggcagcaggtgcagcggttcgcgcgagacttcgcgcagttaccgggtaagtcctactga

SEQ ID NO: 481 - DNA, 534 bp, Artificial Sequence
  Recombinant
atgaaggcgctgatcttgtactcaaccagggacggtcagactcgcaagattgcaagtagcattgcggacgtcatcaggcagcagcagcagtgcgacgtcttaaacattaaagacgcatcacttcctgactgggcccaatatgaccgagtgctcatcggagctagcatccgttacgggcatttccagcccgttgtagacaagttcgtgaagcagcacttgcacgagcttcagcagcggacctccggcttcttctccgtgaacctgacggcgaggaagcctgaaaaaaggagccctgagaccaatgcctacacccagaaattcttggcgcactccccttggcagcccgattgctgtgccgttttcgcgggggccctttactaccccaggtaccgttggttcgaccgggtgatgatccagttgattatgcgcatgactggtggagagaccgactctaccaaggaagtggagtacactgactggcagcaggtgagtaccttcgccaacgattttgcccagcttccaggcaagagctaa

SEQ ID NO: 482 - DNA, 546 bp, Artificial Sequence
  Recombinant
atgaagaccttgattctattctccacaagggacggccagactagggagatcgcttcctacctggccagcgagctaaaggagcttggcattcaggcagacgtggctaacgtgcaccgaattgaggagccgcagtgggagaactacgatcgggtcgtgatcggcgccagcatccggtatggacactaccacagcgcgttccaggagttcgtgaaaaagcacgcgacccgtctgaatagcatgccatcagcgttctactcggtcaacctcgtggctcgtaagcccgagaagcggacaccccagaccaactcgtatgccaggaagttccttatgaactcgcagtggcgaccggaccgctgcgcggtgatcgccggtgcgctcaggtaccctcgttataggtggtacgacaggtttatgattaaacttataatgaaaatgagcggcggagagaccgacaccagaaaagaggtggtttacacagactgggagcaggtagcaaacttcgctagggagattgctcacctcaccgacaagccgaccttgaagtaa

SEQ ID NO: 483 - DNA, 537 bp, Artificial Sequence
  Recombinant
atgaaggcccttatactgttcagttccagagaaggccagacgagggagatagcgagttacattgccaactcgataaaggaggaaatggaatgcgacgtgttcaacatccttcgtgtggagcagatcgactggtctcaatacgaccgcgtcctgatcgggggctcgatacactacggccatttccacccagcggtggcaaaatttgtcaagaggcacctccatgagttgcaacagaggtcttccggctttttctgcgtcaacctgacggccaggaaggccgacaagcggactccccagaccaatgcctacatgagaaagttcttgttgcagtccccatggcaacccgattgctgcgccgtgtttgcgggggcccttaggtacacccgttacaggtggttcgacagggtaatgattcagctgatcatgaggatgacgggcggagagactgacacatcgaaggaggtggagtacacagactggacgcaggtcgcccgcttcgcgcaggagttcgcccatttgcccggcaaaactcagtga

SEQ ID NO: 484 - DNA, 540 bp, Artificial Sequence
  Recombinant
atgaaggctcttatcgtattctcttcgagggatggccaaacccgagcgatcgcgtcttatattgctaataccctcaaagggaccctagagtgcgacgtcgtcaacgtcctcaatgctaacgacattgatttgagccagtacgaccgtgtggccattggcgcctccattcgctacgggaggttccacccagctgttaaccagtttatccggaagcaccttacgagcctccagcagctaccatctgcgttcttctccgtgaacctcacagctcggaagcccgagaagaggactatacaaaccaacgcgtacactaggaagtttctactgaactcgccgtggcagccggacctgtgctgcgtgttcgcgggagcccttcgctatccccgttacaggtggtttgaccgagtgatgattcaactcataatgcgcataacggggggcgagacagactccaccaaggagatcgagtacaccgactggcagcaggtcgcgcgattcgcccaggattttgcacagcttgccgcaaagaacccggcatga

SEQ ID NO: 485 - DNA, 540 bp, Artificial Sequence
  Recombinant
atgaagaccttgatcctattctccaccagggacggccaaacacacaagatcgcaaggcacatcgcaggagtcctcgaagagcaggggaaggcctgcgagttggtcgatctgttacagcccggcgaaccagactggagtaccgttgaatgcgtcgttctaggggccagcattagatatggtcacttccataagtctttcatcaggttcgtaaacactcacgcgcagcgcttgaataatatgccaggcgcccttttcacagttaacttagtcgcccgaaagcccgagaagcagagtccacagacgaactcttacacccgcaagtttctcgccgcctccccttggcagccacagcgatgccaagttttcgcgggcgctttgaggtaccctaggtactcgtggtacgacagaatgatgatacgtttgataatgaagatggccgggggcgagactgacacaaggaaggaggttgagtacactgactggcagtcggtgactcggttcgcgagggagatcgctcagctgccgggagagacgcggtag

SEQ ID NO: 486 - DNA, 537 bp, Artificial Sequence
  Recombinant
atgaaggccctaattttattcagtagtagggacggccagacccagcttatagcatcgtctatcgccaaggagctcgaagggaagcaggcgtgcgacgtgttgaatatcctcgacacgactaatgtggagtggacccagtacgaccgcgtgctgattggagcatccatccggtacgggcactttcaccctgcggtcgccgagttcgtaaagcgtcaccagcgagagctacagcagagaagtagtggctttttctctgtgaacttgacggcccgtaagccggaaaagaggtcccccgagactaacgcctataccgccaagttccttaaccaaagtccatggcagcctgactgttgcgctgtgttcgctggggctttgcgataccctcggtaccgctggttcgacagaattatgatccagctaatcatgcggatgactgggggtgagacagattcttcaaaggaggtcgagtacaccgactggcagcaggtgacccgcttcgcgcaagagttcgccaggcttccgggaaagaccagttga

SEQ ID NO: 487 - DNA, 543 bp, Artificial Sequence
  Recombinant
atgaagaccctaatactgttctctacccgcgacgggcagacaagggagatcgccgcgttccttgcctcggagctgaaggagcaggggatttacgctgacgtcataaaccttaaccggacggaggagatagcttggcaggagtatgatagagtcgtaatcggggcgtcgatccgatacgggcatttccaccctgctgtcgaccgcttcgtgaagaagcacacagagacactcaactcactgcccggcgcctttttctctgtaaaccttgttgcccggaaagccgagaagagaacgccgcagacgaactcatacaccaggaagttcctattaaacagcccgtggaagccagcggcctgcgcggtctttgctggggccctccgctaccctagataccgctggtacgacaggttcatgatacgactgattatgaaaatgacaggcggggagacggatacccgaaaggaggtagtctacactgactggtcgcaggtcgcgtcgtttgccagagagatagtccagttgaccaggtcatcgcgcttgtga

SEQ ID NO: 488 - DNA, 534 bp, Artificial Sequence
  Recombinant
atgaagatattaatccttttctccacccgtgacggccaaacccgtgagattgcggcgtccttggcgtccgaactcaaggagcaggcattcgacgtggacgtcgtcaaccttcaccgggccgagaacatcgcatgggaggagtacgacggtgttgtcatcggagcgtccatcaggtacggccactttcatagtaccctgaactcatttgtcaagaagcatcagcaggctcttaagaagcttcccggggctttctacagcgtgaacctcgtcgcccggaagcctgagaagcgcacaccgcagaccaatagctacacccgcaagttcctcttggattccccgtggcagcccgacctttcagccgtgttcgccggggcactcaggtaccctcggtacaattggtacgaccgtatcatgattagacttatcatgaagattacaggcggcgagactgataccaggaaggaagtagtctacacagactggcagcaggtcactcactttgctcacgagatcgtccagctcgtgcggaagtag

SEQ ID NO: 489 - DNA, 537 bp, Artificial Sequence
  Recombinant
aaggccttggtactgtactcgacgcgggacggccagacccacgcaattgcttcatacatcgcctcctgcatgaaggagaaggccgaatgcgacgtgatcgacctcacccacggggagcacgtgaacctcacccaatacgatcaggtgctaatcggtgcgagtattcgttacggccacttcaacgccgtgcttgacaagttcatcaagagaaacgtggatcagctgaacaacatgccaagcgcgttcttctgcgtaaacctcacagcaaggaagcccgagaagcgtactccccagacaaacccttatgtccgaaaattcttgcttgctaccccctggcagcccgcgttgtgcggagtgttcgcaggggcccttcggtacccgcgataccggtggatcgacaaggtgatgatccagctaataatgcggatgactgggggagagacagacacgagcaaggaggtcgagtacacggattgggagcaggttaagaagttcgcggaggattttgcaaagctatcgtacaagaaggccctctag

SEQ ID NO: 490 - DNA, 534 bp, Artificial Sequence
  Recombinant
aaggccttgatcctgttctctacacgcgacggacagacacagaagatcgcatctgccatcgctgatgagataaaggggcagcaatcgtgcgacgtgattaacatacaggatgccaaaaccctcgactggcagcagtacgaccgggtactcatcggcgcctccattcgttacgggcatttccagcccgttgtgaatgagtttgtcaagcacaacctcttggccctacagcagagagtttccggattcttctccgtgaacttgacagcccgaaagccagagaagcggagccccgagactaacgcttatacagtcaaattcttggcgcagtcaccctggcaaccggactgctgcgctgtttttgcgggggccctgtactacccacggtaccggtggttcgatagggtgatgatacagttcataatgcgaatgacggggggagagaccgacgcatcgaaagaggtggagtacactgactggcagcaggtgcagcggttcgcgcgagacttcgcgcagttaccgggtaagtcctactga

SEQ ID NO: 491 - DNA, 543 bp, Artificial Sequence
  Recombinant
aagaccttgattctattctccacaagggacggccagactagggagatcgcttcctacctggccagcgagctaaaggagcttggcattcaggcagacgtggctaacgtgcaccgaattgaggagccgcagtgggagaactacgatcgggtcgtgatcggcgccagcatccggtatggacactaccacagcgcgttccaggagttcgtgaaaaagcacgcgacccgtctgaatagcatgccatcagcgttctactcggtcaacctcgtggctcgtaagcccgagaagcggacaccccagaccaactcgtatgccaggaagttccttatgaactcgcagtggcgaccggaccgctgcgcggtgatcgccggtgcgctcaggtaccctcgttataggtggtacgacaggtttatgattaaacttataatgaaaatgagcggcggagagaccgacaccagaaaagaggtggtttacacagactgggagcaggtagcaaacttcgctagggagattgctcacctcaccgacaagccgaccttgaagtaa

SEQ ID NO: 492 - DNA, 534 bp, Artificial Sequence
  Recombinant
aaggcccttatactgttcagttccagagaaggccagacgagggagatagcgagttacattgccaactcgataaaggaggaaatggaatgcgacgtgttcaacatccttcgtgtggagcagatcgactggtctcaatacgaccgcgtcctgatcgggggctcgatacactacggccatttccacccagcggtggcaaaatttgtcaagaggcacctccatgagttgcaacagaggtcttccggctttttctgcgtcaacctgacggccaggaaggccgacaagcggactccccagaccaatgcctacatgagaaagttcttgttgcagtccccatggcaacccgattgctgcgccgtgtttgcgggggcccttaggtacacccgttacaggtggttcgacagggtaatgattcagctgatcatgaggatgacgggcggagagactgacacatcgaaggaggtggagtacacagactggacgcaggtcgcccgcttcgcgcaggagttcgcccatttgcccggcaaaactcagtga

SEQ ID NO: 493 - DNA, 537 bp, Artificial Sequence
  Recombinant
aaggctcttatcgtattctcttcgagggatggccaaacccgagcgatcgcgtcttatattgctaataccctcaaagggaccctagagtgcgacgtcgtcaacgtcctcaatgctaacgacattgatttgagccagtacgaccgtgtggccattggcgcctccattcgctacgggaggttccacccagctgttaaccagtttatccggaagcaccttacgagcctccagcagctaccatctgcgttcttctccgtgaacctcacagctcggaagcccgagaagaggactatacaaaccaacgcgtacactaggaagtttctactgaactcgccgtggcagccggacctgtgctgcgtgttcgcgggagcccttcgctatccccgttacaggtggtttgaccgagtgatgattcaactcataatgcgcataacggggggcgagacagactccaccaaggagatcgagtacaccgactggcagcaggtcgcgcgattcgcccaggattttgcacagcttgccgcaaagaacccggcatga

SEQ ID NO: 494 - DNA, 537 bp, Artificial Sequence
  Recombinant
aagaccttgatcctattctccaccagggacggccaaacacacaagatcgcaaggcacatcgcaggagtcctcgaagagcaggggaaggcctgcgagttggtcgatctgttacagcccggcgaaccagactggagtaccgttgaatgcgtcgttctaggggccagcattagatatggtcacttccataagtctttcatcaggttcgtaaacactcacgcgcagcgcttgaataatatgccaggcgcccttttcacagttaacttagtcgcccgaaagcccgagaagcagagtccacagacgaactcttacacccgcaagtttctcgccgcctccccttggcagccacagcgatgccaagttttcgcgggcgctttgaggtaccctaggtactcgtggtacgacagaatgatgatacgtttgataatgaagatggccgggggcgagactgacacaaggaaggaggttgagtacactgactggcagtcggtgactcggttcgcgagggagatcgctcagctgccgggagagacgcggtag

SEQ ID NO: 495 - DNA, 540 bp, Artificial Sequence
  Recombinant
aagaccctaatactgttctctacccgcgacgggcagacaagggagatcgccgcgttccttgcctcggagctgaaggagcaggggatttacgctgacgtcataaaccttaaccggacggaggagatagcttggcaggagtatgatagagtcgtaatcggggcgtcgatccgatacgggcatttccaccctgctgtcgaccgcttcgtgaagaagcacacagagacactcaactcactgcccggcgcctttttctctgtaaaccttgttgcccggaaagccgagaagagaacgccgcagacgaactcatacaccaggaagttcctattaaacagcccgtggaagccagcggcctgcgcggtctttgctggggccctccgctaccctagataccgctggtacgacaggttcatgatacgactgattatgaaaatgacaggcggggagacggatacccgaaaggaggtagtctacactgactggtcgcaggtcgcgtcgtttgccagagagatagtccagttgaccaggtcatcgcgcttgtga

SEQ ID NO: 496 - DNA, 537 bp, Artificial Sequence
  Recombinant
aaggccttggtactgtactcgacgcgggacggccagacccacgcaattgcttcatacatcgcctcctgcatgaaggagaaggccgaatgcgacgtgatcgacctcacccacggggagcacgtgaacctcacccaatacgatcaggtgctaatcggtgcgagtattcgttacggccacttcaacgccgtgcttgacaagttcatcaagagaaacgtggatcagctgaacaacatgccaagcgcgttcttctgcgtaaacctcacggcaaggaagcccgagaagcgtactccccagacaaacccttatgtccgaaaattcttgcttgctaccccctggcagcccgcgttgtgcggagtgttcgcaggggcccttcggtacccgcgataccggtggatcgacaaggtgatgatccagctaataatgcggatgactgggggagagacagacacgagcaaggaggtcgagtacacggattgggagcaggttaagaagttcgcggaggattttgcaaagctatcgtacaagaaggccctctag

SEQ ID NO: 497 - DNA, 537 bp, Artificial Sequence
  Recombinant
aaggccttggtactgtactcgacgcgggacggccagacccacgcaattgcttcatacatcgcctcctgcatgaaggagaaggccgaatgcgacgtgatcgacctcacccacggggagcacgtgaacctcacccaatacgatcaggtgctaatcggtgcgaatattcgttacggccacttcaacgccgtgcttgacaagttcatcaagagaaacgtggatcagctgaacaacatgccaagcgcgttcttctgcgtaaacctcacagcaaggaagcccgagaagcgtactccccagacaaacccttatgtccgaaaattcttgcttgctaccccctggcagcccgcgttgtgcggagtgttcgcaggggcccttcggtacccgcgataccggtggatcgacaaggtgatgatccagctaataatgcggatgactgggggagagacagacacgagcaaggaggtcgagtacacggattgggagcaggttaagaagttcgcggaggattttgcaaagctatcgtacaagaaggccctctag

SEQ ID NO: 498 - DNA, 537 bp, Artificial Sequence
  Recombinant
aaggccttggtactgtactcgacgcgggacggccagacccacgcaattgcttcatacatcgcctcctgcatgaaggagaaggccgaatgcgacgtgatcgacctcacccacggggagcacgtgaacctcacccaatacgatcaggtgctaatcggtgcgagtattcgttacggccacttcaacgccgtgcttgacaagttcatcaagagaaacgtggatcagctgaacaacatgccaagcgcgttcttctgcgtaaacctcacagcaaggaagcccgagaagcgtactccccagacaaacccttatgtccgaaaattcttgcttgctaccccctggcagcccgcgttgtgcggagtgttcgcaggggcccttcggtacccgcgataccggtggatcgacaaggtgatgatccagctaataatgcggatgactgggggagagacagacacgagcaaggaggtcgagtacacggattgggagcaggttaagaagttcgcggaggattttgcaaagctatagtacaagaaggccctctag

SEQ ID NO: 499 - DNA, 534 bp, Artificial Sequence
  Recombinant
aaggccttgatcctgttctctacacgcgacggacagacacagaagatcgcatctgccatcgctgatgagataaaggggcagcaatcgtgcgacgtgattaacatacaggatgccaaaaccctcgactggcagcagtacgaccgggtactcatcggcgcctccattcgttacgggcatttccagcccgttgtgaatgagtttgtcaagcacaacctcttggccctacagcagagagtttccggattcttctccgtgaacttgacagcccgaaagccagagaagcggagccccgagactaacgcttatacagtcaaattcttggcgcagtcaccctggcaaccggactgctgcgctgtttttgcgggggccctgtactacccacggtaccggtggttcgatagggtgatgatacagttcataatgcgaatgacggggggggagaccgacgcatcgaaagaggtggagtacactgactggcagcaggtgcagcggttcgcgcgagacttcgcgcagttaccgggtaagtcctactga

SEQ ID NO: 500 - DNA, 540 bp, Artificial Sequence
  Recombinant
aagaccctaatactgttctctacccgcgacgggcagacaagggagatcgccgcgttccttgcctcggagctgaaggagcaggggatttacgctgacgtcataaaccttaaccggacggaggagatagcttggcaggagtatgatagagtcgtaatcggggcgtcgatccgatacgggcatttccaccctgctgtcgaccgcttcgtgaagaagcacacagagacactcaactcactgcccggcgcctttttctctgtaaaccttgttgcccggaaagccgagaagagaacgccgcagacgaactcatacaccaggaagttcctattaaacagcccgtggaagccagcggcctgcgcggtctttgctggggccctccgctaccctagataccgctggtacgacaggttcatgatacgactgattatgaaaatgacaggcggggagacggatacccgaaaggaggtagtctacactgactggtcgcagatcgcgtcgtttgccagagagatagtccagttgaccaggtcatcgcgcttgtga

SEQ ID NO: 501 - DNA, 540 bp, Artificial Sequence
  Recombinant
atgaaggcgctcgtgctctacagcacacgcgacggccagactcatgcgatcgcctcttacatcgcgtcctgtatgaaggagaaggccgagtgcgacgtcatcgatctcacgcacggggagcacgtgaatcttacgcagtacgaccaagtgctgataggcgcctctatccgttacggccattttaacgccgtcctcgacaaattcatcaagcgcaatgtagaccagctgaacaacatgccctccgcgttcttttgcgtgaacctgacggctcggaagcctgagaagcgaacacctcagaccaacccatacgtgcggaaattcctactcgcaacgccatggcagcccgccctgtgcggggttttcgcaggggcgctacgctatccgcgttaccgctggatcgataaggtgatgatccagctaataatgcgcatgaccggcggcgagacagacacatcgaaggaagtcgaatacacagactgggaacaggtgaagaagtttgcagaggatttcgccaagctctcatacaaaaaggcattgtga

SEQ ID NO: 502 - DNA, 537 bp, Artificial Sequence
  Recombinant
atgaaggcgcttatactgttctcgacacgcgacggtcagacgcagaaaatcgcctcagccatcgccgacgagatcaagggccagcagagctgcgatgtgatcaatattcaggacgccaaaactctcgactggcagcagtatgaccgcgtgctcattggcgcatcaatccgctacgggcatttccagccagtcgtcaatgagtttgtgaaacataacctcttggcattgcagcagcgggtgtctggcttcttctccgtgaaccttacagctagaaaaccagagaagcggtcgcccgagactaacgcctacaccgttaagttccttgcgcagtcaccgtggcagcctgattgctgcgcggtcttcgccggggcactgtactaccctcgataccggtggtttgatagggtaatgatccagttcataatgcgcatgaccggtggggagaccgacgcaagtaaagaagttgagtacacggattggcagcaggtgcaaaggttcgcacgcgacttcgcgcagctcccgggcaagtcttactga

SEQ ID NO: 503 - DNA, 534 bp, Artificial Sequence
  Recombinant
atgaaagccctgatcctctattccaccagggacggccagacccgcaagatagcctcctccatcgctgatgtcatccgccagcagcagcagtgcgacgttttaaacattaaggacgcttcactgcctgattgggcccagtatgaccgcgtcctgatcggcgcgtcgattcggtacggccacttccagcctgtggttgacaagttcgtcaagcagcacctgcatgagctgcagcagcgaactagcgggttcttcagtgtgaacctgacagctagaaagcccgaaaagagatccccagaaaccaacgcctatacgcagaaattccttgctcactcaccctggcagcctgactgttgtgccgtcttcgcgggcgccttgtactatccccgctaccgctggttcgatagggtgatgatccagctgattatgagaatgacgggaggggagaccgattcgaccaaggaggtagagtacactgactggcaacaggtgtcaactttcgcaaacgacttcgcacaactacccggtaagtcttga

SEQ ID NO: 504 - DNA, 546 bp, Artificial Sequence
  Recombinant
atgaaaaccctaatactgttctcgacccgcgacggccagacgcgtgagattgcgagctacctggcctccgagctcaaggagctggggatccaagccgatgtcgcgaacgtgcaccgcattgaggagccgcagtgggagaattacgatcgcgttgtgataggggccagcatccgctatggccactaccactcggcctttcaggagtttgtaaagaaacacgccacaagattaaactccatgcctagcgccttctactccgtcaaccttgtcgcgcgcaagccggagaagcggacacctcagacgaactcctacgcgcggaagttcctgatgaacagccagtggcggccggacagatgtgctgttattgcgggagccctgagatacccgaggtaccggtggtacgataggtttatgattaaacttattatgaagatgtctggtggggagactgacaccaggaaggaggtggtatatacagactgggagcaggtcgccaatttcgctcgggaaatcgcgcatctgacagacaagcctacactgaagtag

SEQ ID NO: 505 - DNA, 537 bp, Artificial Sequence
  Recombinant
atgaaggccctgatcctctttagctctagggagggccagacccgcgagatcgcgtcatatatcgcgaattccataaaggaggagatggagtgcgatgtgtttaacatccttagggtggagcaaatagactggtctcagtatgaccgtgtgctcataggggggagcatccactacggccactttcacccggccgtggcgaaattcgtcaagcgacacctccacgagcttcagcagcgctcctcagggttcttctgcgtcaacctgacagcaagaaaggcagataaacgcaccccgcagacgaacgcctacatgaggaagttccttctgcagtctccttggcagcccgattgctgcgcggtgttcgccggtgcactgcgctatacgcgctatagatggtttgatagagtcatgattcagctcatcatgcggatgaccggcggggaaacggatactagtaaggaggtggagtacacggactggacccaggtggcacgtttcgcccaggagtttgcacatcttcctgggaagacccaatga

SEQ ID NO: 506 - DNA, 540 bp, Artificial Sequence
  Recombinant
atgaaggcgctaattgtgttcagctccagggatggccagacgagggctatagcatcctatatcgccaataccttgaaaggaacgctcgagtgtgacgtggtcaacgtcttgaacgccaatgacattgacctttcccagtacgaccgagttgccataggcgcgtcgatccgctacgggcgatttcaccctgcagtcaaccagtttatacggaagcatttgacctcgctgcagcagctcccgtcagccttcttctctgtgaatttaaccgcgcggaagcctgagaaacggacgatccaaacaaacgcctatacccgaaagttcctcctgaacagcccatggcagccagacctgtgctgtgtcttcgccggcgcgttgcggtatccccgctacaggtggttcgatagagtgatgatccagctcatcatgaggatcaccgggggagagaccgatagtaccaaggagatcgagtacacggactggcagcaggtggctcgcttcgcccaggacttcgctcagttggccgcaaagaatccagcataa

SEQ ID NO: 507 - DNA, 540 bp, Artificial Sequence
  Recombinant
atgaagacactgatcctgttctcgactcgagatggccagactcataaaattgcgcgccacattgcgggggtcctggaggagcagggcaaagcgtgcgagctcgtggacttactccagcccggggagccggactggagcacggtggagtgcgtcgttctgggcgcttccatacgttacgggcatttccacaaaagtttcatccggttcgtcaacacccacgctcaacggctgaacaacatgcctggcgcgctattcactgttaacttagtggctcgtaagcccgagaagcagtctccgcagactaactcctacacaaggaaatttctagcagcaagcccatggcaaccgcagcggtgccaggtgttcgctggagctctgcgctatcctaggtacagttggtacgacagaatgatgatacggttgattatgaagatggcaggcggggagacggacaccaggaaagaggtcgaatacactgactggcaatcagtcactcggtttgctagagagatcgcgcaattaccaggtgagacgcggtaa

SEQ ID NO: 508 - DNA, 537 bp, Artificial Sequence
  Recombinant
atgaaggctctcatactgttcagctcgagagacgggcagacccagctgatcgcctcctccatagcaaaggagctagagggcaagcaagcctgcgacgtgctcaatattctcgacacaaccaacgtggagtggactcagtacgacagagtcctaatcggcgcgtccatcagatacggccacttccatcccgccgtcgctgaattcgtgaaacgccaccagcgtgagctccagcagcgcagcagcggcttcttcagcgtgaatcttactgcgagaaagccggaaaagcggagtcccgagactaacgcttatacggcaaagttcctcaaccaatctccctggcaaccagactgctgtgccgtgttcgctggggcactgaggtatccgcgctatcggtggttcgatagaatcatgatacagctgataatgcgtatgactggtggggagacggattccagtaaagaggtagagtatactgattggcagcaggtcactaggttcgcgcaggagtttgctaggctgccgggcaagacatcctga

SEQ ID NO: 509 - DNA, 543 bp, Artificial Sequence
  Recombinant
atgaaaaccttaatcttgttcagcacccgcgacggccagacgcgtgaaatcgcagcgttcctcgcttcggagctcaaggaacagggaatttacgccgacgtcattaacctaaaccgtaccgaagagattgcgtggcaggagtatgaccgcgtggtgattggcgcttctatccgctatggccacttccacccggctgttgaccggttcgtgaagaagcacacggagaccttgaactcactgccgggggcattctttagcgtaaatctggtggcgcgcaaggccgagaagcgcaccccccagacgaacagctacacccgcaaatttttacttaactccccatggaaacctgcggcctgcgcagtgttcgcaggagctctccgctatcctcgctatcgatggtacgatcggttcatgattcggctgattatgaaaatgacgggcggcgagacggatacgcgaaaggaagttgtctacactgactggtcccaggtggcctcgtttgcaagggagatcgtacagctcactcgatctagtaggctctga

SEQ ID NO: 510 - DNA, 534 bp, Artificial Sequence
  Recombinant
atgaagattctcatcttattttccacccgagacggccaaacccgcgagattgcggcgtccctcgcctccgagttgaaggagcaggcgtttgatgtggatgtggtcaacctccaccgcgcagaaaacatagcgtgggaggagtacgatggggtcgtcatcggagcgtcaatccgctacggacatttccactcaacgctgaattcatttgtgaagaagcaccaacaagcgctcaagaagctgcccggagcattctacagcgtcaacctcgtggctcggaagccggaaaagcgcaccccgcaaacaaacagctacacacgcaagtttctgctcgactcgccctggcaacccgacctgagtgccgttttcgccggggcactgcgctatccccgttacaactggtacgatcgcataatgattcgactgatcatgaagattacaggcggggaaaccgatactcggaaggaggtggtgtatacagactggcagcaggttacccacttcgcccacgagatcgtccagctcgttcgtaagtga

SEQ ID NO: 511 - protein, 442 aa, Xanthomonas campestris
MQTQPVIIAGAGIAGLSIAYELQQKGIPYEIMEASSYAGGVVKSLHIDGYELDAGPNSLAASAAFMAYIDQLGLQDQVLEAAAASKNRFLVRNDKLHAVSPHPFKILQSAYISGGAKWRLFTERFRKAAAPEGEETVSSFVTRRFGKEINDYLFEPVLSGIYAGNPDLMSVGEVLPMLPQWEQKYGSVTQGLLKNKGAMGGRKIIAFKGGNATLTNRLQSLLSGKIRFNCAVTGVTRGADDYIVQYTENGNTAMLNASRVIFTTPAYSTAVAIQALDASLATHLSDVPYPRMGVLHLGFGAEARQKAPAGFGFLVPHAAGKHFLGAICNSAIFPSRVPTGKVLFTVFLGGARQEQLFDQLGPEKLQQTVVKELMELLGLTTPPEMQRFSEWNRAIPQLNVGYAQTRQQIGVFEQRYPGIRLAGNYVTGVAVPAIIQAAKGYC

SEQ ID NO: 512 - protein, 448 aa, Chitinophaga pinensis
MSDQPVLIVGAGLSGLSIAYELQKLQVPYQVLEVSGHSGGVMKSLRKDGFELDAGANTIAASPEILAYFTSLGLENEILQATAASKHRFLVRRRQLHAVSPHPFKIMSSPYLSRGSKWRLFTERFRKPVVASGEETVTDFITRRFNREIAEYVFDPVLSGIYAGNPDQMSIAEVLPALPRWEREYGSVTKGLMKDKGAMGGRKIISFKGGNQLLTNRLQQLLTTPVRFNCKVTGITASNGGYIVSAVEDGVSESYTASRVILTTPAYSAAATITNLDAATAALLNEIHYPRMGVLHLGFDATALPQPLDGFGFLVPNAENMHFLGAICNAAIFPDKAPPGKILFTVFLGGARQESLFDQMTPEALQQQVVSEVMSLLHLSAPPVMQHFSSWNKAIPQLNVGHVKLRRAVEAFEKKYPGIHLSGNYLQGVAIPALLQHAAALAASLKKN

SEQ ID NO: 513 - protein, 470 aa, Bacillus subtilis
MSDGKKHVVIIGGGITGLAAAFYMEKEIKEKNLPLELTLVEASPRVGGKIQTVKKDGYIIERGPDSFLERKKSAPQLVKDLGLEHLLVNNATGQSYVLVNRTLHPMPKGAVMGIPTKIAPFVSTGLFSLSGKARAAMDFILPASKTKDDQSLGEFFRRRVGDEVVENLIEPLLSGIYAGDIDKLSLMSTFPQFYQTEQKHRSLILGMKKTRPQGSGQQLTAKKQGQFQTLSTGLQTLVEEIEKQLKLTKVYKGTKVTKLSHSGSGYSLELDNGVTLDADSVIVTAPHKAAAGMLSELPAISHLKNMHSTSVANVALGFPEGSVQMEHEGTGFVISRNSDFAITACTWTNKKWPHAAPEGKTLLRAYVGKAGDESIVDLSDNDIINIVLEDLKKVMNINGEPEMTCVTRWHESMPQYHVGHKQRIKELREALASAYPGVYMTGASFEGVGIPDCIDQGKAAVSDALTYLFS

SEQ ID NO: 514 - protein, 470 aa, Bacillus pumilus
MHDNQKHLVIIGGGITGLAAAFYLEKEVEEKGLPIQISLIEASPRLGGKIQTLYKDGYIIERGPDSFLERKVSGPQLAKDVGLSDQLVNNETGQAYVLVNEKLHPMPKGAVMGIPTQISPFITTGLFSVAGKARAAMDFVLPKSKQTEDQSLGEFFRRRVGDEVVENLIEPLLSGIYAGDIDRLSLMSTFPQFYQTEQQHRSLILGMKKSQQHAKAQQVTAKKQGQFQTINQGLQSLVEAVEGKLKLTTVYKGTKVKQIEKTDGGYGLQLDSGQTLFADSAIVTTPHQSIYSMFPKEAGLEYLHDMTSTSVATVALGFKDEDVHNEYDGTGFVISRNSDFSITACTWTNKKWPHTAPKGKTLLRAYVGKAGDESIVEQSDSQIVSIVLEDLKKIMDIKADPELTTVTRWKTSMPQYHVGHQKAISNMRETFKQSYPGVYITGAAFEGVGIPDCIDQGKAAISEAVSYLFS

SEQ ID NO: 515 - protein, 470 aa, Bacillus pumilus
MHDNQKHLVIIGGGITGLAAAFYLEKEVEEKGLPIQISLIEASPRLGGKIQTLYKDGYIIERGPDSFLERKVSGPQLAKDVGLSDQLVNNETGQAYVLVNETLHPMPKGAVMGIPTQISPFITTGLFSVAGKARAAMDFVLPKSKQTEDQSLGEFFRRRVGDEVVENLIEPLLSGIYAGDIDRLSLMSTFPQFYQTEQKHRSLILGMKKSQQHAKAQQVTAKKQGQFQTINQGLQALVEAVESKLKLTTIYKGTKVKQIEKTDGGYGVQLDSGQTLLADSAIVTTPHQSIYSMFPKEAGLEYLHDMTSTSVATVALGFKEEDVHNEYDGTGFVISRNSDFSITACTWTNKKWPHTAPKGKTLLRAYVGKAGDESIVEQSDHQIVSIVLEDLKKIMDIKADPELTTVTRWKTSMPQYHVGHQKAISNMRETFKQSYPGVYITGAAFEGVGIPDCIDQGKAAISEAVSYLFS

SEQ ID NO: 516 - protein, 439 aa, Xanthomonas campestris
QPVIIAGAGIAGLSIAYELQQKGIPYEIMEASSYAGGVVKSLHIDGYELDAGPNSLAASAAFMAYIDQLGLQDQVLEAAAASKNRFLVRNDKLHAVSPHPFKILQSAYISGGAKWRLFTERFRKAAAPEGEETVSSFVTRRFGKEINDYLFEPVLSGIYAGNPDLMSVGEVLPMLPQWEQKYGSVTQGLLKNKGAMGGRKIIAFKGGNATLTNRLQSLLSGKIRFNCAVTGVTRGADDYIVQYTENGNTAMLNASRVIFTTPAYSTAVAIQALDASLATHLSDVPYPRMGVLHLGFGAEARQKAPAGFGFLVPHAAGKHFLGAICNSAIFPSRVPTGKVLFTVFLGGARQEQLFDQLGPEKLQQTVVKELMELLGLTTPPEMQRFSEWNRAIPQLNVGYAQTRQQIGVFEQRYPGIRLAGNYVTGVAVPAIIQAAKGYC

SEQ ID NO: 517 - protein, 445 aa, Chitinophaga pinensis
QPVLIVGAGLSGLSIAYELQKLQVPYQVLEVSGHSGGVMKSLRKDGFELDAGANTIAASPEILAYFTSLGLENEILQATAASKHRFLVRRRQLHAVSPHPFKIMSSPYLSRGSKWRLFTERFRKPVVASGEETVTDFITRRFNREIAEYVFDPVLSGIYAGNPDQMSIAEVLPALPRWEREYGSVTKGLMKDKGAMGGRKIISFKGGNQLLTNRLQQLLTTPVRFNCKVTGITASNGGYIVSAVEDGVSESYTASRVILTTPAYSAAATITNLDAATAALLNEIHYPRMGVLHLGFDATALPQPLDGFGFLVPNAENMHFLGAICNAAIFPDKAPPGKILFTVFLGGARQESLFDQMTPEALQQQVVSEVMSLLHLSAPPVMQHFSSWNKAIPQLNVGHVKLRRAVEAFEKKYPGIHLSGNYLQGVAIPALLQHAAALAASLKKN

SEQ ID NO: 518 - protein, 448 aa, Artificial Sequence
  Recombinant
MSDQPVLIVGAGLSGLSIAYELQKLQVPYQVLEVSGHSGGVMKSLRKDGFELDAGANTIATSPEILAYFTSLGLENEILQATATSKHRFLVRRRQLHAVSPHPFKIMSSPYLCRGSKWRLFTERFRKPVVASGEETVTDFITRRFNREIAEYVFDPVLSGIYAGNPDQMSIAEVLPALPRWEREYGSVTKGLMKDKGAMGGRKIISFKGGNQLLTNRLQQLLTTPVRFNCKVTGITASNGGYIVSAVEDGVSESYTASRVILTTPAYSAAATITNLDAATAALLNEIHYPRMGVLHLGFDATALPQPLDGFGFLVPNAENMHFLGAICNAAIFPDKAPPGKILFTVFLGGARQESLFDQMTPEALQQQVVSEVMSLLHLSAPPVMQHFSSWNKAIPQLNVGHVKLRRAVEAFEKKYPGIHLSGNYLQGVAIPALLQHAAALAASLKKN

SEQ ID NO: 519 - protein, 445 aa, Artificial Sequence
  Recombinant
QPVLIVGAGLSGLSIAYELQKLQVPYQVLEVSGHSGGVMKSLRKDGFELDAGANTIATSPEILAYFTSLGLENEILQATATSKHRFLVRRRQLHAVSPHPFKIMSSPYLCRGSKWRLFTERFRKPVVASGEETVTDFITRRFNREIAEYVFDPVLSGIYAGNPDQMSIAEVLPALPRWEREYGSVTKGLMKDKGAMGGRKIISFKGGNQLLTNRLQQLLTTPVRFNCKVTGITASNGGYIVSAVEDGVSESYTASRVILTTPAYSAAATITNLDAATAALLNEIHYPRMGVLHLGFDATALPQPLDGFGFLVPNAENMHFLGAICNAAIFPDKAPPGKILFTVFLGGARQESLFDQMTPEALQQQVVSEVMSLLHLSAPPVMQHFSSWNKAIPQLNVGHVKLRRAVEAFEKKYPGIHLSGNYLQGVAIPALLQHAAALAASLKKN

SEQ ID NO: 520 - protein, 445 aa, Artificial Sequence
  Recombinant
QPVLIVGAGLSGLSIAYELQKLQVPYQVLEVSGHSGGVMKSLRKDGFELDAGANTIATSPEILAYFTSLGLENEILQATAASKHRFLVRRRQLHAVSPHPFKIMSSPYLSRGSKWRLFTERFRKPVVASGEETVTDFITRRFNREIAEYVFDPVLSGIYAGNPDQMSIAEVLPALPRWEREYGSVTKGLMKDKGAMGGRKIISFKGGNQLLTNRLQQLLTTPVRFNCKVTGITASNGGYIVSAVEDGVSESYTASRVILTTPAYSAAATITNLDAATAALLNEIHYPRMGVLHLGFDATALPQPLDGFGFLVPNAENMHFLGAICNAAIFPDKAPPGKILFTVFLGGARQESLFDQMTPEALQQQVVSEVMSLLHLSAPPVMQHFSSWNKAIPQLNVGHVKLRRAVEAFEKKYPGIHLSGNYLQGVAIPALLQHAAALAASLKKN

SEQ ID NO: 521 - protein, 445 aa, Artificial Sequence
  Recombinant
QPVLIVGAGLSGLSIAYELQKLQVPYQVLEVSGHSGGVMKSLRKDGFELDAGANTIATSPEILAYFTSLGLENEILQATATSKHRFLVRRRQLHAVSPHPFKIMSSPYLCRGSKWRLFTERFRKPVVASGEETVTDFITRRFNREIAEYVFDPVLSGIYAGNPDQMSIAEVLPALPRWEREYGSVTKGLMKDKGAMGGRKIISFKGGNQLLTNRLQQLLTTPVRFNCKVTGITASNGGYIVSAVEDGVSESYTASRVILTTPAYSAAATITNLDAATAALLNEIHYPRMGVLHLGFDATALPQPLDGFGFLVPNAENMHFLGAICNAAIFPDKAPPGKILFTVFLGGARQESLFDQMTPEALQQQVVSEVMSLLHLSAPPVMQHFSSWNKAIPQLNVGHVKLRRAVEAFEKKYPGIHLSGNYLQGVAITALLQHAAALAASLKKN

SEQ ID NO: 522 - protein, 445 aa, Artificial Sequence
  Recombinant
QPVLIVGAGLSGLSIAYELQKLQVPYQVLEVSGHSGGVMKSLRKDGFELDAGANTIATSPEILAYFTSLGLENEILQATATSKHRFLVRRRQLHAVSPHPFKIMSSPYLCRGSKWRLFTERFRKPVVASGEETVTDFITRRFNREIAEYVFDPVLSGIYAGNPDQMSIAEVLPALPRWEREYGSVTKGLMKDKGAMGGRKIISFKGGNQLLTNRLQQLLTTPVRFNYKVTGITASNGGYIVSAVEDGVSESYTASRVILTTPAYSAAATITNLDAATAALLNEIHYPRMGVLHLGFDATALPQPLDGFGFLVPNAENMHFLGAICNAAIFPDKAPPGKILFTVFLGGARQESLFDQMTPEALQQQVVSEVMSLLHLSAPPVMQHFSSWNKAIPQLNVGHVKLRRAVEAFEKKYPGIHLSGNYLQGVAIPALLQHAAALAASLKKN

SEQ ID NO: 523 - protein, 477 aa, Paenibacillus macerans
MSKKIAVIGGGITGLSVAYYVRKLLREQGVNAGVTLVEQSDRLGGKIRSLRRDGFTIEQGPDSMIARKPAALELIRELGLEDKLAGTNPQAKRSYILHRGKFHPMPPGLMLGIPTQMWPMVKTGLLSPAGKLRAAMDLLLPARRGGGDESLGGFIRRRLGREVLEQMTEPLLAGIYAGDTEQLSLKATFPQFMEMERKHRSLILGLLAGKKQPPRPGGSQVPLPKAAQTSMFLTLTGGLEGLTEALEESLSEEKIITGQAVTGLSQQEAGYELNLSGGERLNADGVILAVPAFAAARLLDGVPEAAYLERIRYVSVANLAFAYRREDVPHDLNGSGVLIPRGEGRMITAITWVSSKWLHSAPGDKALLRAYIGRLGDEAWTAMCRADIERRVAAELRDLLGIAASPLFCELAALPESMPQYPVGHVERLEALRGALCRAKPGLLLCGAGYAGVGIPDCIRQGKEAAESMAAYLRDGR

SEQ ID NO: 524 - protein, 493 aa, Paenibacillus thiaminolyticus
MKALRKLVVIGGGITGLSAAFYALKQADEEGQPISVTIIEQSDRLGGKIQTLRKEGCVIEKGPDSFLARKLPMIDLARDLGMDSELVATNPHAKKTYILRRGKLYRMPPGLVLGIPTELGPFAKTGLISPWGKLRAAMDLFIKPHPADEDESVGAFLDRRLGREVTEHIAEPLLAGIYAGDLQALSLQATFPQFAQVERKHGGLIRGMKASRQAGQSVPGLPDVAKGTMFLTFRNGLTSLVERLEETLRDRAELCLGIGAEGFEKREDGTYLVRLSDGSRLQADAVIVTTPSYHAASLLEEHVDASALQAIRHVSVANVVSVFDRKQVNNQFDGTGFVISRREGRAITACTWTSVKWPHTSRGDKLIIRCYIGRAGDEERVDWPDEALKRTVRSELRELLDIDIDPEFVEITRLRHSMPQYPVGHVQAIRSLRDEVGRTLPGVFLAGQPYEGVGMPDCVRSGRDAAEAAVSAMQAMSTEPEAPAEDAATGTAG

SEQ ID NO: 525 - protein, 474 aa, Paenibacillus polymyxa
MGDKKRRVVVVGGGLTGLSAAFYIRKHYREAGVEPVITLVEKSSSMGGMIETLHRDGFVIEKGPDSFLARKTAMIDLAKELEIDHELVSQNPESKKTYIMQRGKLHPMPAGLVLGIPTELRPFLRSGLVSPAGKLRALMDFVIPPRRTTEDESLGYMIERRLGAEVLENLTEPLLAGIYAGDMRRLSLQATFPQFGEVERDYGSLIRGMMTGRKPAETHTGTKRSAFLNFRQGLQSLVHALVHELQDVDQRLNTAVKSLQRLDGAQTRYRVELGNGEMLEADDVVVTVPTYVASELLKPHVDTAALDAINYVSVANVVLAFEKKEVEHVFDGSGFLVPRKEGRNITACTWTSTKWLHTSPDDKVLLRCYVGRSGDEQNVELPDEALTNLVLKDLRETMGIEAVPIFSEITRLRKSMPQYPVGHLQHIAALREELGSKLPGVYIAGAGYEGVGLPDCIRQAKEMSVQATQELAAD

SEQ ID NO: 526 - protein, 470 aa, Bacillus atrophaeus
MSDGKKHLVIIGGGITGLASAFYMEKEIREKNLPLSVTLVEASPRVGGKIQTARKDGYIIERGPDSFLERKKSAPELVEDLGLEHLLVNNATGQSYVLVNETLHPMPKGAVMGIPTKIAPFMSTGLFSFSGKARAAMDFVLPASKPKEDQSLGEFFRRRVGDEVVENLIEPLLSGIYAGDIDRLSLMSTFPQFYQTEQKHRSLILGMKKTRPQGSGQRLTAKKQGQFQTLKTGLQTLVEELENQLKLTKVYKGTKVTNISRGEKGCSIALDNGMTLDADAAIVTSPHKSAAGMFPDLPAVSQLKDMHSTSVANVALGFPQEAVQMEHEGTGFVISRNSDFSITACTWTNKKWPHSAPEGKTLLRAYVGKAGDESIVELSDNEIIKIVLEDLKKVMKIKGEPEMTCVTRWNESMPQYHVGHKQRIKKVREALAASYPGVYMTGASFEGVGIPDCIDQGKSAVSDVLAYLFG

SEQ ID NO: 527 - protein, 470 aa, Bacillus atrophaeus
MSDGKKHLVIIGGGITGLASAFYMEKEIREKNLPLSVTLVEASPRVGGKIQTARKDGYIIERGPDSFLERKKSAPELVEDLGLEHLLVNNATGQSYVLVNETLHPMPKGAVMGIPTKIAPFMSTRLFSFSGKARAAMDFVLPASKPKEDQSLGEFFRRRVGDEVVENLIEPLLSGIYAGDIDRLSLMSTFPQFYQTEQKHRSLILGMKKTRPQGSGQQLTAKKQGQFQTLKTGLQTLVEELENQLKLTKVYKGTKVTNISRGEKGCSIALDNGMTLDADAAIVTSPHKSAAGMFPDLPAVSQLKDMHSTSVANVALGFPQEAVQMEHEGTGFVISRNSDFSITACTWTNKKWPHSAPEGKTLLRAYVGKAGDESIVELSDNEIIKIVLEDLKKVMKIKGEPEMTCVTRWNESMPQYHVGHKQRIKKVREALAASYPGVYMTGASFEGVGIPDCIDQGKSAVSDVLAYLFE

SEQ ID NO: 528 - protein, 475 aa, Artificial Sequence
  Recombinant
KKIAVIGGGITGLSVAYYVRKLLREQGVNAGVTLVEQSDRLGGKIRSLRRDGFTIEQGPDSMIARKPAALELIRELGLEDKLAGTNPQAKRSYILHRGKFHPMPPGLMLGIPTQMWPMVKTGLLSPAGKLRAAMDLLLPARRGGGDESLGGFIRRRLGREVLEQMTEPLLAGIYAGDTEQLSLKATFPQFMEMERKHRSLILGLLAGKKQPPRPGGSQVPLPKAAQTSMFLTLTGGLEGLTEALEESLSEEKIITGQAVTGLSQQEAGYELNLSGGERLNADGVILAVPAFAAARLLDGVPEAAYLERIRYVSVANLAFAYRREDVPHDLNGSGVLIPRGEGRMITAITWVSSKWLHSAPGDKALLRAYIGRLGDEAWTAMCRADIERRVAAELRDLLGIAASPLFCELAALPESMPQYPVGHVERLEALRGALCRAKPGLLLCGAGYAGVGIPDCIRQGKEAAESMAAYLRDGR

SEQ ID NO: 529 - protein, 489 aa, Artificial Sequence
  Recombinant
RKLVVIGGGITGLSAAFYALKQADEEGQPISVTIIEQSDRLGGKIQTLRKEGCVIEKGPDSFLARKLPMIDLARDLGMDSELVATNPHAKKTYILRRGKLYRMPPGLVLGIPTELGPFAKTGLISPWGKLRAAMDLFIKPHPADEDESVGAFLDRRLGREVTEHIAEPLLAGIYAGDLQALSLQATFPQFAQVERKHGGLIRGMKASRQAGQSVPGLPDVAKGTMFLTFRNGLTSLVERLEETLRDRAELCLGIGAEGFEKREDGTYLVRLSDGSRLQADAVIVTTPSYHAASLLEEHVDASALQAIRHVSVANVVSVFDRKQVNNQFDGTGFVISRREGRAITACTWTSVKWPHTSRGDKLIIRCYIGRAGDEERVDWPDEALKRTVRSELRELLDIDIDPEFVEITRLRHSMPQYPVGHVQAIRSLRDEVGRTLPGVFLAGQPYEGVGMPDCVRSGRDAAEAAVSAMQAMSTEPEAPAEDAATGTAG

SEQ ID NO: 530 - protein, 469 aa, Artificial Sequence
  Recombinant
RRVVVVGGGLTGLSAAFYIRKHYREAGVEPVITLVEKSSSMGGMIETLHRDGFVIEKGPDSFLARKTAMIDLAKELEIDHELVSQNPESKKTYIMQRGKLHPMPAGLVLGIPTELRPFLRSGLVSPAGKLRALMDFVIPPRRTTEDESLGYMIERRLGAEVLENLTEPLLAGIYAGDMRRLSLQATFPQFGEVERDYGSLIRGMMTGRKPAETHTGTKRSAFLNFRQGLQSLVHALVHELQDVDQRLNTAVKSLQRLDGAQTRYRVELGNGEMLEADDVVVTVPTYVASELLKPHVDTAALDAINYVSVANVVLAFEKKEVEHVFDGSGFLVPRKEGRNITACTWTSTKWLHTSPDDKVLLRCYVGRSGDEQNVELPDEALTNLVLKDLRETMGIEAVPIFSEITRLRKSMPQYPVGHLQHIAALREELGSKLPGVYIAGAGYEGVGLPDCIRQAKEMSVQATQELAAD

SEQ ID NO: 531 - protein, 465 aa, Artificial Sequence
  Recombinant
KHLVIIGGGITGLASAFYMEKEIREKNLPLSVTLVEASPRVGGKIQTARKDGYIIERGPDSFLERKKSAPELVEDLGLEHLLVNNATGQSYVLVNETLHPMPKGAVMGIPTKIAPFMSTRLFSFSGKARAAMDFVLPASKPKEDQSLGEFFRRRVGDEVVENLIEPLLSGIYAGDIDRLSLMSTFPQFYQTEQKHRSLILGMKKTRPQGSGQQLTAKKQGQFQTLKTGLQTLVEELENQLKLTKVYKGTKVTNISRGEKGCSIALDNGMTLDADAAIVTSPHKSAAGMFPDLPAVSQLKDMHSTSVANVALGFPQEAVQMEHEGTGFVISRNSDFSITACTWTNKKWPHSAPEGKTLLRAYVGKAGDESIVELSDNEIIKIVLEDLKKVMKIKGEPEMTCVTRWNESMPQYHVGHKQRIKKVREALAASYPGVYMTGASFEGVGIPDCIDQGKSAVSDVLAYLFE

SEQ ID NO: 532 - protein, 473 aa, Artificial Sequence
  Recombinant
IAVIGGGITGLSVAYYVRKLLREQGVNAGVTLVEQSDRLGGKIRSLRRDGFTIEQGPDSMIARKPAALELIRELGLEDKLAGTNPQAKRSYILHRGKFHPMPPGLMLGIPTQMWPMVKTGLLSPAGKLRAAMDLLLPARRGGGDESLGGFIRRRLGREVLEQMTEPLLAGIYAGDTEQLSLKATFPQFMEMERKHRSLILGLLAGKKQPPRPGGSQVPLPKAAQTSMFLTLTGGLEGLTEALEESLSEEKIITGQAVTGLSQQEAGYELNLSGGERLNADGVILAVPAFAAARLLDGVPEAAYLERIRYVSVANLAFAYRREDVPHDLNGSGVLIPRGEGRMITAITWVSSKWLHSAPGDKALLRAYIGRLGDEAWTAMCRADIERRVAAELRDLLGIAASPLFCELAALPESMPQYPVGHVERLEALRGALCRAKPGLLLCGAGYAGVGIPDCIRQGKEAAESMAAYLRDGR

SEQ ID NO: 533 - protein, 487 aa, Artificial Sequence
  Recombinant
LVVIGGGITGLSAAFYALKQADEEGQPISVTIIEQSDRLGGKIQTLRKEGCVIEKGPDSFLARKLPMIDLARDLGMDSELVATNPHAKKTYILRRGKLYRMPPGLVLGIPTELGPFAKTGLISPWGKLRAAMDLFIKPHPADEDESVGAFLDRRLGREVTEHIAEPLLAGIYAGDLQALSLQATFPQFAQVERKHGGLIRGMKASRQAGQSVPGLPDVAKGTMFLTFRNGLTSLVERLEETLRDRAELCLGIGAEGFEKREDGTYLVRLSDGSRLQADAVIVTTPSYHAASLLEEHVDASALQAIRHVSVANVVSVFDRKQVNNQFDGTGFVISRREGRAITACTWTSVKWPHTSRGDKLIIRCYIGRAGDEERVDWPDEALKRTVRSELRELLDIDIDPEFVEITRLRHSMPQYPVGHVQAIRSLRDEVGRTLPGVFLAGQPYEGVGMPDCVRSGRDAAEAAVSAMQAMSTEPEAPAEDAATGTAG

SEQ ID NO: 534 - protein, 467 aa, Artificial Sequence
  Recombinant
VVVVGGGLTGLSAAFYIRKHYREAGVEPVITLVEKSSSMGGMIETLHRDGFVIEKGPDSFLARKTAMIDLAKELEIDHELVSQNPESKKTYIMQRGKLHPMPAGLVLGIPTELRPFLRSGLVSPAGKLRALMDFVIPPRRTTEDESLGYMIERRLGAEVLENLTEPLLAGIYAGDMRRLSLQATFPQFGEVERDYGSLIRGMMTGRKPAETHTGTKRSAFLNFRQGLQSLVHALVHELQDVDQRLNTAVKSLQRLDGAQTRYRVELGNGEMLEADDVVVTVPTYVASELLKPHVDTAALDAINYVSVANVVLAFEKKEVEHVFDGSGFLVPRKEGRNITACTWTSTKWLHTSPDDKVLLRCYVGRSGDEQNVELPDEALTNLVLKDLRETMGIEAVPIFSEITRLRKSMPQYPVGHLQHIAALREELGSKLPGVYIAGAGYEGVGLPDCIRQAKEMSVQATQELAAD

SEQ ID NO: 535 - protein, 463 aa, Artificial Sequence
  Recombinant
LVIIGGGITGLASAFYMEKEIREKNLPLSVTLVEASPRVGGKIQTARKDGYIIERGPDSFLERKKSAPELVEDLGLEHLLVNNATGQSYVLVNETLHPMPKGAVMGIPTKIAPFMSTRLFSFSGKARAAMDFVLPASKPKEDQSLGEFFRRRVGDEVVENLIEPLLSGIYAGDIDRLSLMSTFPQFYQTEQKHRSLILGMKKTRPQGSGQQLTAKKQGQFQTLKTGLQTLVEELENQLKLTKVYKGTKVTNISRGEKGCSIALDNGMTLDADAAIVTSPHKSAAGMFPDLPAVSQLKDMHSTSVANVALGFPQEAVQMEHEGTGFVISRNSDFSITACTWTNKKWPHSAPEGKTLLRAYVGKAGDESIVELSDNEIIKIVLEDLKKVMKIKGEPEMTCVTRWNESMPQYHVGHKQRIKKVREALAASYPGVYMTGASFEGVGIPDCIDQGKSAVSDVLAYLFE

SEQ ID NO: 536 - DNA, 1329 bp, Xanthomonas campestris
atgcaaacacagcccgttatcattgccggcgccggtattgccggactaagtatagcttacgaattacagcagaaaggcattccctatgaaatcatggaggcctcttcctatgcaggaggcgttgtgaaatcattacatattgatggttatgaactggatgctggccctaattcgctggccgcatctgcagcattcatggcttatatcgatcaactgggtttgcaggaccaggtattggaagctgcggctgccagtaagaaccgctttctggtcagaaatgataaattgcatgcagtatcgccacatccctttaagatactgcagtcagcatatatcagtggtggcgccaagtggcgtctgttcacagaaagatttcgaaaagcggccgctccggagggagaggaaacagtatcttcctttgtgacccgccgttttggaaaggagatcaatgactacctttttgaacccgtgctttctggtatatatgcaggtaatcctgatctgatgtcagttggtgaagtactgcctatgctgccacaatgggagcaaaaatacggtagtgttacgcagggactcctgaagaataaaggagctatgggtggacgtaagatcattgcctttaaaggaggtaatgcgacactgacaaacagattgcaatccctgcttagcggtaagataagatttaactgtgccgtaacgggtgtaacccgtggggcggacgactatattgtacaatataccgagaatggtaatacagctatgctgaatgcatcccgtgtgatattcaccacccctgcatacagtacagccgtagctatacaggcacttgacgcttcccttgctacacatctcagcgatgttccctatccccgtatgggcgtactgcacctggggtttggagcggaagcccggcagaaagcaccggcaggttttggtttcctggtgccgcatgctgcaggaaagcatttcctgggcgctatctgtaacagcgctatattcccttcccgcgtaccgacaggtaaagtgctgtttacggtgttcctgggtggcgcgagacaagaacagctgtttgatcagctggggcctgaaaagctacagcagacagtagtgaaagaactgatggaactgctgggcctgactacaccaccagaaatgcagcgttttagtgaatggaacagagcgattccgcaactaaatgtaggttatgcacagacgaggcagcagataggcgtttttgaacagcgttacccgggcatcagattagcgggtaactatgtgaccggagtggctgtacccgctatcatacaggccgcaaaagggtactgttga

SEQ ID NO: 537 - DNA, 1347 bp, Chitinophaga pinensis
atgtctgatcaacccgtattgattgtcggcgccggcttatccggattgagcattgcgtatgaattgcagaaactgcaggtgccttaccaggtactggaagtttcgggtcatagcggcggcgtgatgaaatcattacggaaagatggatttgaactggatgcaggcgctaatacaatcgcagcttctcctgaaatactggcatacttcacatcactgggactggaaaatgagatattgcaggccaccgctgccagcaagcaccggttcctggtaagacggcggcagttgcacgctgtttctccccatcctttcaagatcatgtcgtctccttacctgagcaggggcagtaaatggcggttgtttaccgaacgttttcgcaaacctgttgtggcaagcggagaagaaaccgtcaccgattttataacaagaaggtttaaccgggagatagcagaatatgtgtttgacccggtattatccggcatatatgccggcaatcccgaccagatgagcatagcggaagtattacctgcgttgccgcgctgggagcgggaatatgggagtgttaccaaagggctgatgaaagataaaggcgcaatgggcggccggaagattatcagttttaaaggtggtaaccagttgctcacaaaccgtttgcagcaattgctcactaccccggtgcgctttaattgtaaggtaaccggtatcaccgcatccaatggcggctatattgtaagcgctgtagaagatggcgtatcagaaagttatactgcttcaagggtgatattaaccacacctgcttacagcgcggcagcaactattacgaatcttgatgctgctaccgctgccttgttaaatgaaattcattatccccgtatgggcgtgctgcacctgggttttgacgctactgcgttgccgcagcccctggatggatttggtttcctggtaccgaatgctgaaaatatgcatttcctgggagcaatctgcaacgctgcaattttcccggataaggcgcctccgggaaaaatcctctttacggtattcctgggaggagcaagacaggaaagtttgtttgaccagatgacgcccgaagctctgcaacagcaggtagtttcagaggtcatgtctttactgcatttatctgcgccgccggtaatgcagcatttcagtagctggaataaagcgattccgcagttaaatgtgggtcatgttaagttacggcgtgccgtggaagcttttgaaaaaaaatatcccggtattcacctcagcgggaattacctgcaaggcgtagctatcccggctttactgcaacatgccgccgctttggcggcttccctgaagaaaaattaa

SEQ ID NO: 538 - DNA, 1413 bp, Bacillus subtilis
atgagtgacggcaaaaaacatgtagtcatcatcggcggcggcattaccggtttagccgccgccttctatatggaaaaagaaatcaaagaaaagaatctgccgcttgaactgacgcttgttgaggcaagtccgagagtcggcggaaaaatccagactgtcaagaaggacggctatatcatcgaaagagggccagactcatttctggaacgaaagaaaagcgccccgcagcttgttaaagacttaggtcttgagcatttgcttgtcaacaatgcgaccggacaatcctatgtgcttgtaaaccgcactctgcatccaatgccgaagggcgctgtaatggggataccgacaaaaattgcgccgtttgtttctacgggtctgttttctttgtctgggaaggcgagagctgctatggatttcatcctgcctgctagcaaaacaaaggatgatcagtcattgggagaattcttccgcagacgtgtcggagatgaagtggtcgagaacttaatcgagccgcttctatcagggatctacgcaggcgacattgacaagctcagcctgatgtcgacattcccgcaattttatcagacggaacaaaagcatagaagcctgattctcggcatgaaaaaaacaaggcctcaaggctcaggccagcagctgacggcaaaaaaacaagggcagttccagactctgtcaaccggtttgcagacccttgtagaagagatcgaaaagcagttaaagctgacgaaggtgtataaaggcacaaaagtgaccaaactcagccatagcggctctggctattcgctcgaactggataacggcgtcacacttgatgctgattcagtaattgtgactgctccgcataaagcggctgcgggaatgctttctgagcttcctgccatttctcatttgaaaaatatgcactccacatccgtggcaaacgtcgctttaggtttccctgaaggctccgtccaaatggagcatgagggcacgggttttgtcatttcaagaaacagtgactttgcgatcacagcctgtacgtggacgaataaaaaatggccgcacgcagcgccggaaggcaaaacgctgcttcgggcatatgtcggaaaagctggagacgaatccattgtcgatctatcagataatgacattatcaacattgtgttagaagacttaaagaaagtcatgaacataaacggcgagccggaaatgacatgtgtcacccgatggcatgaaagcatgccgcagtaccatgtcggccataagcagcgtatcaaggagctgcgtgaagcacttgcatctgcgtatccgggtgtttatatgacaggcgcttctttcgaaggtgtcggcattcccgactgcattgatcaaggaaaagctgccgtgtctgacgcgcttacctatttattcagctaa

SEQ ID NO: 539 - DNA, 1413 bp, Bacillus pumilus
atgcatgacaatcaaaaacaccttgtcatcattggcggtggcatcactggtttagccgccgccttctatttggaaaaggaagtcgaggaaaaaggtcttccgattcaaatatcacttattgaagcgagccctaggctaggtggaaaaatacaaacattatataaagacggctacatcattgaacgtggacctgattcatttttagaaagaaaggtcagtgggccgcagcttgcaaaagatgtcggtctgtccgatcagctcgtcaataatgaaactgggcaagcgtatgtactggtcaatgaaaagcttcacccgatgccaaaaggtgctgttatggggattccaactcaaatcagcccatttattacaactggtcttttttcagttgcgggaaaagcaagagcggcgatggatttcgtgttgccaaaaagcaagcagacggaagaccagtcgcttggtgaattttttagaagacgtgtgggtgatgaggtcgttgagaatttaattgagccgcttctatcaggcatttatgcaggggatattgaccgtctgagcttaatgtcgaccttcccgcaattttatcaaacagaacagcagcatcgaagtttgattcttgggatgaaaaaatcacagcagcatgcgaaagcgcagcaagtgactgcgaaaaaacaaggacagttccaaacgatcaatcaaggattgcagtcgcttgtggaagcagtagaaggtaagctcaagctgacaacggtctataaagggacaaaagtcaaacaaattgaaaaaacggatggaggctatggcttacaattagacagcggtcaaacgctttttgccgattcagccattgtcacgactccgcatcaatcgatttattccatgtttcctaaagaagcagggctagagtatttgcatgacatgacctctacttctgttgcaacagtagcactcggttttaaagatgaggatgttcataatgaatatgacggcactggatttgtcatctcaagaaacagtgatttctctattacggcctgtacatggacaaacaaaaaatggccgcatactgctccgaaaggaaaaacgctattgcgtgcgtatgtagggaaggctggcgacgaatcaattgtcgagcagtcagacagtcaaatcgtcagcattgtgctagaagatttaaagaaaatcatggatattaaagcagatccagaattgacgacagtgactcgctggaagacaagtatgccgcaatatcacgtcggtcatcagaaagccatttcgaacatgcgagaaacgtttaagcaatcatatcctggtgtttatattacaggtgctgcttttgaaggtgtcggaatccctgattgtattgatcaaggaaaagccgccatctcagaggctgtatcgtatctattttcataa

SEQ ID NO: 540 - DNA, 1413 bp, Bacillus pumilus
atgcatgacaatcaaaaacaccttgtcatcattggcggtggcatcactggtttagccgccgccttctatttggaaaaggaagtcgaagaaaaaggtcttcccattcaaatatctcttattgaagcgagccctaggctaggtggaaaaatccaaacattatataaagacggctacatcattgaacgtgggcctgattcatttttagaaagaaaggtcagtggaccgcagctggcgaaagatgtaggtctatccgatcagctcgtcaataatgaaacagggcaggcgtatgtactagtcaatgaaacccttcacccgatgccaaaaggcgctgtcatgggtattccaactcaaatcagcccattcatcacaaccggtcttttttcagttgcaggaaaagcgagagccgcaatggatttcgtcttgccaaaaagcaagcaaacagaagatcagtcgctcggtgaattttttagaagacgtgtcggtgatgaagtagttgagaatttaatcgaacctcttctatcaggcatttatgcaggtgacattgaccgtctcagcttaatgtccaccttcccgcagttttatcaaacagaacaaaagcatcgcagtttgattcttgggatgaaaaaatcacagcagcatgcgaaagcgcagcaagtgacagcgaaaaaacaagggcagttccaaacgatcaatcaaggacttcaagcgcttgttgaagcagtagaaagcaagctcaagctgacaacgatttataaagggacaaaagtgaagcagattgaaaaaacagatgggggctacggtgtgcagttagacagcggtcaaacgcttttggctgattcagccattgtgacaactccgcatcaatcgatctattccatgtttccaaaagaagcggggcttgagtacttgcatgatatgacatctacttctgttgcaacggttgcactcggttttaaagaagaggatgttcataatgaatatgacggtactggttttgtcatctcaagaaacagtgatttctctattacagcttgtacgtggacgaacaaaaaatggccgcatacagctcctaaaggaaaaacattattgcgtgcttatgtagggaaggctggcgacgaatcaattgtcgaacagtcagaccatcaaatcgtcagcattgtactggaggatttgaagaaaattatggatattaaagcagatccagaactgacaacagtgactcgctggaagacgagcatgccgcaatatcacgtcggtcatcaaaaagccatttcgaacatgcgagaaacgtttaagcaatcatatcctggtgtttatatcacaggtgctgcttttgaaggtgtcggaatccctgattgtattgatcaaggaaaagctgccatttcagaggctgtatcttatctattttcataa

SEQ ID NO: 541 - DNA, 1329 bp, Artificial Sequence
  Recombinant
atgcaaactcagcccgtcataatagcgggcgctggcattgcgggcctttctatcgcatacgagctgcaacagaagggcattccttacgaaattatggaagcctcgtcctacgccggaggcgtggtcaagtcccttcacattgatggctacgaactagacgccggacctaattcacttgccgcgtccgctgccttcatggcctacatcgaccaactcggactccaagatcaagtgcttgaagccgccgcagcatccaagaaccgcttcctcgtaagaaacgacaagctccatgcagtctcgccgcacccgtttaagatcctccagtcggcctacatcagtggcggcgctaagtggagattgtttaccgaaaggttccgcaaagctgcggctccagagggtgaggagacagtgagcagcttcgtgacgaggaggtttggcaaggagatcaacgactacctgtttgaacccgtcttgtccgggatctacgcgggcaacccggatttgatgagtgttggcgaggttctgccgatgcttcctcaatgggagcagaagtacggcagcgttacacaaggcttgttgaagaataagggcgcaatgggcggccgaaagataatcgctttcaagggcgggaatgccacactgaccaaccgtcttcagtcactgctctcaggaaagatccgcttcaattgcgccgtgacgggtgtcacacgaggcgcagacgactacattgttcagtacactgagaatggcaataccgcaatgttgaatgcaagccgcgtgatcttcacaacacccgcttactcaactgctgttgccatccaggcgttggacgccagcttggccactcacctctctgatgtaccctatcctcgcatgggtgtgttgcacttgggcttcggtgctgaggcaaggcagaaggctcctgcgggctttgggttcttggtcccacacgcagccggaaagcacttcctgggagcaatctgtaactccgctatcttcccttcgcgggtgcccactggcaaggtgttattcaccgtgttcttgggcggtgccagacaggagcaactgtttgaccagctaggccctgagaagttacaacagacagtggtgaaggagcttatggaattgctgggcctaactacgccgccggagatgcaacgattctctgagtggaatcgcgcaataccgcaacttaatgttggctacgcccagactcgtcagcagattggcgtattcgagcagcgctaccctggcatccgcttggccgggaactatgtaactggagtggcggtgcccgccattatccaagctgcaaagggctattgctaa

SEQ ID NO: 542 - DNA, 1347 bp, Artificial Sequence
  Recombinant
atgagcgaccagcccgtcctcatcgttggagctggtctctccgggctctcaatcgcttacgaactacagaagctgcaagtcccttaccaagtgctggaggtttctggacattctggtggagtcatgaagtcactccggaaggacggatttgaactcgacgctggtgccaacaccatagccgcgtctcccgagattcttgcgtactttacctcactaggtcttgagaatgagatcctccaggcgactgctgcttctaaacaccgcttcttggtgcggcgaaggcaactgcacgccgtgagcccgcacccgttcaagatcatgtcatcgccgtacctcagccgtggctccaaatggcggctctttactgagcggtttcggaagcccgtcgtcgcttcgggcgaggagaccgtcaccgatttcatcacgaggagattcaaccgcgaaatagcggagtatgtgttcgaccctgttctaagcgggatctacgccgggaacccggaccaaatgagtattgctgaggtgttgcctgccttgcctaggtgggaaagggagtacggatcagtgaccaagggccttatgaaggataagggtgcgatgggaggtcgaaagatcatcagctttaagggtggcaaccagctacttacaaaccgcttacagcagctactcactactccggtgagattcaattgcaaggtgacagggattacagccagcaatggcgggtacatcgtgagcgctgttgaggacggcgtatctgagagctacaccgcatctcgtgtgatcttgaccacacccgcttactcagcagcggctaccataactaaccttgatgcagccactgcggcactgttgaacgaaatccattatccacgtatgggcgtgttacacttgggctttgatgcaactgccttgccacagccgctggacgggttcggatttctagtgccgaacgcggagaacatgcacttcctgggagccatctgcaatgcagccatcttcccggacaaggctccgcccggcaagatcctgtttacagtgttcctcggaggcgcacgccaggagtcgctcttcgatcagatgactcctgaggctcttcagcagcaagtcgttagtgaggtgatgagcttgttgcacttgtcagctccaccggtgatgcagcacttctcctcctggaacaaggccatccctcaattgaacgtcgggcacgtgaagttgcggcgcgcggtagaggcgttcgagaagaaataccctggaatccatctctcgggcaactacctccagggagttgcaataccagctttactccagcacgccgcagctttagctgcttctcttaagaagaactga

SEQ ID NO: 543 - DNA, 1413 bp, Artificial Sequence
  Recombinant
atgtcggatggcaagaagcacgtcgtcatcataggcggtgggatcactggcttggccgctgcattctacatggagaaggagattaaggagaagaacctcccacttgagctgacgctagttgaggccagtcccagggtcggcggcaagatccagacggtcaagaaggacgggtacataattgaacgcggccctgacagcttcttagagcgcaagaaatcggctccgcagctagttaaggacttgggacttgagcacctgctcgtcaacaacgcgaccggacagtcgtacgtgctcgtgaaccggacgctccacccgatgccgaagggcgctgtgatgggcattccgaccaagatagcaccattcgtgagtaccggcctattcagcctttccggcaaggcaagggctgcgatggacttcatcttgcctgcctctaagactaaggacgatcagtccttgggcgagttcttccgccgccgggtgggtgatgaggtggtggagaacttaattgagccgctcctatctggaatctacgctggtgacatcgacaaactgtctctgatgtccacctttccgcagttctaccaaactgagcagaagcaccgttcacttatcttgggaatgaagaagactagacctcaaggttcgggtcagcaactgacggccaagaaacagggtcagttccagacgctaagcaccgggcttcagacactcgtggaggagattgagaaacagctcaaacttactaaggtgtacaagggcacgaaggtgacaaagttatcccactccggcagcgggtactccctggagttggacaatggcgtaacgttggacgccgactcagttatcgtgacagcgccgcataaggctgctgccgggatgttgtcagaactcccggcgatttcccatctcaagaacatgcacagtacctcggttgccaacgtcgccctcggattcccggaaggaagtgttcaaatggagcacgaaggcacgggtttcgtaatttccaggaactccgactttgccatcaccgcttgtacttggaccaacaagaagtggcctcatgctgcgccggagggcaagacattgctcagagcttacgtcgggaaggcgggcgacgagtcaatcgtcgatcttagcgacaacgacatcattaacattgtgctggaggacttgaagaaggttatgaacatcaatggcgagccagagatgacctgcgtgacccgatggcacgagtctatgccgcagtaccacgtcggtcacaagcagcgcatcaaggagttgcgcgaggcactcgcctcagcttaccctggcgtgtacatgactggcgcttcgtttgagggcgttggtattcctgactgcatcgaccagggaaaggcggccgtcagtgacgcgctcacctacctcttcagttga

SEQ ID NO: 544 - DNA, 1413 bp, Artificial Sequence
  Recombinant
atgcacgacaaccagaagcacctggtcataatcggaggcggcataaccggccttgctgcggccttctacctggagaaggaggtcgaggagaagggtctccctatccagatttcattgattgaggcttcgcctcggctgggagggaagatccagacattgtacaaggacgggtacatcatcgagcgtggtccagacagtttcctggagcggaaggtcagcggaccgcagctcgccaaggacgtgggacttagcgaccaactggtgaacaacgagacaggacaggcgtacgtcttggtgaatgagaagttgcacccgatgcctaagggtgccgtgatgggcatcccaacgcaaatctcacctttcatcaccaccggactcttctccgtggccggaaaggcacgagctgcaatggacttcgttctgcctaagtcgaaacagaccgaagaccagtctctaggcgagttcttccgccgccgtgtgggtgacgaggttgtggagaacctcatcgagcctttgttgtctgggatctacgcgggcgacatcgacagacttagtctcatgagtacctttccgcaattctatcagacagaacagcagcatcgaagtctcatactcgggatgaagaagtcacaacaacatgcaaaggcccagcaagttaccgccaagaaacagggccagttccaaacgatcaaccagggcctccagagcttggtggaggcagtggagggaaagttgaagctcaccaccgtttacaaagggacaaaggttaaacagattgagaagacggacggcggttacgggttacaattggactccggacagactctcttcgctgattccgctatcgtaactactcctcaccagagcatctactctatgttcccgaaggaggcgggcctggagtacctgcacgacatgacttcaacgtctgtcgccaccgtggctttgggcttcaaggacgaggacgtccacaatgagtatgacgggacgggattcgttatcagtaggaactccgacttcagcatcaccgcctgcacgtggaccaacaagaagtggccacacaccgcgcccaaagggaagacccttctgagggcatacgtgggcaaggcgggcgacgagagcatcgtcgagcaatctgattctcagattgtttcaatcgtcctcgaagacctcaagaagatcatggacatcaaggcagacccggaacttaccaccgttactcgatggaagacctcgatgcctcagtatcacgtcgggcaccagaaggcaatcagcaacatgagggagacattcaagcagtcgtatcctggcgtgtacattaccggagcagcattcgaaggcgtaggaatccctgactgcattgaccagggcaaggctgctatctcagaggccgtgtcctatctcttctcgtga

SEQ ID NO: 545 - DNA, 1413 bp, Artificial Sequence
  Recombinant
atgcacgacaaccagaagcacctggtgataattggaggcgggattaccggcctagcagccgctttctatctggagaaggaggtggaggagaagggcctcccgatacagatttcgctgattgaagcctctccgcgcctgggcggcaagatccagacattgtacaaggacgggtacatcattgagcgcgggcctgactcgttcctggagcggaaggtctccggtcctcaactggccaaagacgtgggtctttccgatcagcttgtgaacaatgagaccggtcaggcttacgtcttggtcaacgaaactctgcatcccatgcctaagggagccgttatgggcattccaacgcaaatctctccgttcataacgactgggctgttcagcgttgcgggcaaagcaagggctgctatggacttcgtgctgccaaagagtaagcagaccgaggaccagtccctcggcgagttcttccgccgccgagtgggcgatgaggtggttgagaatctaatcgaaccgctgttgtcgggcatctatgcgggcgacatcgacaggctaagtcttatgtccactttccctcagttctaccagacagagcagaaacacaggagtctcatccttggaatgaagaagtcccagcagcacgcgaaggctcagcaagtgaccgccaagaagcaaggacagttccagaccatcaaccagggcctacaggcccttgtcgaagccgttgagtcgaagttaaagttgacgacgatctacaagggcaccaaggtgaagcagattgagaagactgacggtggctatggtgtgcaactcgattcgggccaaacattgctcgctgactccgctatcgtcacgacgccacaccagtcgatctactcgatgttcccgaaggaggcgggcctagagtaccttcacgacatgacctccacttcggtcgccaccgttgcactcggctttaaggaggaggacgttcacaacgagtacgatggcaccggattcgtgatctccaggaactcggacttctcgattaccgcgtgcacgtggacaaataagaagtggccgcacacagcgccaaagggcaagacccttctgcgggcgtatgtgggcaaggccggtgacgagagcattgtcgaacaatctgaccatcagatcgtttctattgttcttgaggatctcaagaagataatggacattaaggccgaccctgagcttaccacagtgacgaggtggaagacctcgatgccgcagtatcacgtagggcaccagaaggccatctccaacatgcgggagacattcaagcagtcgtaccctggcgtgtacattactggcgctgctttcgagggcgttggcatcccggactgcatcgaccagggcaaggccgcaatctcagaggcagtgtcgtacctgttcagctag

SEQ ID NO: 546 - DNA, 1320 bp, Artificial Sequence
  Recombinant
cagcccgtcataatagcgggcgctggcattgcgggcctttctatcgcatacgagctgcaacagaagggcattccttacgaaattatggaagcctcgtcctacgccggaggcgtggtcaagtcccttcacattgatggctacgaactagacgccggacctaattcacttgccgcgtccgctgccttcatggcctacatcgaccaactcggactccaagatcaagtgcttgaagccgccgcagcatccaagaaccgcttcctcgtaagaaacgacaagctccatgcagtctcgccgcacccgtttaagatcctccagtcggcctacatcagtggcggcgctaagtggagattgtttaccgaaaggttccgcaaagctgcggctccagagggtgaggagacagtgagcagcttcgtgacgaggaggtttggcaaggagatcaacgactacctgtttgaacccgtcttgtccgggatctacgcgggcaacccggatttgatgagtgttggcgaggttctgccgatgcttcctcaatgggagcagaagtacggcagcgttacacaaggcttgttgaagaataagggcgcaatgggcggccgaaagataatcgctttcaagggcgggaatgccacactgaccaaccgtcttcagtcactgctctcaggaaagatccgcttcaattgcgccgtgacgggtgtcacacgaggcgcagacgactacattgttcagtacactgagaatggcaataccgcaatgttgaatgcaagccgcgtgatcttcacaacacccgcttactcaactgctgttgccatccaggcgttggacgccagcttggccactcacctctctgatgtaccctatcctcgcatgggtgtgttgcacttgggcttcggtgctgaggcaaggcagaaggctcctgcgggctttgggttcttggtcccacacgcagccggaaagcacttcctgggagcaatctgtaactccgctatcttcccttcgcgggtgcccactggcaaggtgttattcaccgtgttcttgggcggtgccagacaggagcaactgtttgaccagctaggccctgagaagttacaacagacagtggtgaaggagcttatggaattgctgggcctaactacgccgccggagatgcaacgattctctgagtggaatcgcgcaataccgcaacttaatgttggctacgcccagactcgtcagcagattggcgtattcgagcagcgctaccctggcatccgcttggccgggaactatgtaactggagtggcggtgcccgccattatccaagctgcaaagggctattgctaa

SEQ ID NO: 547 - DNA, 1338 bp, Artificial Sequence
  Recombinant
cagcccgtcctcatcgttggagctggtctctccgggctctcaatcgcttacgaactacagaagctgcaagtcccttaccaagtgctggaggtttctggacattctggtggagtcatgaagtcactccggaaggacggatttgaactcgacgctggtgccaacaccatagccgcgtctcccgagattcttgcgtactttacctcactaggtcttgagaatgagatcctccaggcgactgctgcttctaaacaccgcttcttggtgcggcgaaggcaactgcacgccgtgagcccgcacccgttcaagatcatgtcatcgccgtacctcagccgtggctccaaatggcggctctttactgagcggtttcggaagcccgtcgtcgcttcgggcgaggagaccgtcaccgatttcatcacgaggagattcaaccgcgaaatagcggagtatgtgttcgaccctgttctaagcgggatctacgccgggaacccggaccaaatgagtattgctgaggtgttgcctgccttgcctaggtgggaaagggagtacggatcagtgaccaagggccttatgaaggataagggtgcgatgggaggtcgaaagatcatcagctttaagggtggcaaccagctacttacaaaccgcttacagcagctactcactactccggtgagattcaattgcaaggtgacagggattacagccagcaatggcgggtacatcgtgagcgctgttgaggacggcgtatctgagagctacaccgcatctcgtgtgatcttgaccacacccgcttactcagcagcggctaccataactaaccttgatgcagccactgcggcactgttgaacgaaatccattatccacgtatgggcgtgttacacttgggctttgatgcaactgccttgccacagccgctggacgggttcggatttctagtgccgaacgcggagaacatgcacttcctgggagccatctgcaatgcagccatcttcccggacaaggctccgcccggcaagatcctgtttacagtgttcctcggaggcgcacgccaggagtcgctcttcgatcagatgactcctgaggctcttcagcagcaagtcgttagtgaggtgatgagcttgttgcacttgtcagctccaccggtgatgcagcacttctcctcctggaacaaggccatccctcaattgaacgtcgggcacgtgaagttgcggcgcgcggtagaggcgttcgagaagaaataccctggaatccatctctcgggcaactacctccagggagttgcaataccagctttactccagcacgccgcagctttagctgcttctcttaagaagaactga

SEQ ID NO: 548 - DNA, 1344 bp, Artificial Sequence
  Recombinant
atgagcgaccaacccgtcctcatcgttggagctggtctctccgggctctcaatcgcttacgaactacagaagctgcaagtcccttaccaagtgctggaggtttctggacattctggtggagtcatgaagtcactccggaaggacggatttgaactcgacgctggtgccaacaccatagccacgtctcccgagattcttgcgtactttacctcactaggtcttgagaatgagatcctccaggcgactgctacttctaaacaccgcttcttggtgcggcgaaggcaactgcacgccgtgagcccgcacccgttcaagatcatgtcatcgccgtacctctgccgtggctccaaatggaggctctttactgagcggtttcggaaacccgtcgtcgcttcgggcgaggagaccgtcaccgatttcatcacgaggagattcaaccgcgaaatagcggagtatgtgttcgaccctgttctaagtgggatctacgccgggaacccggaccaaatgagtattgctgaggtgttgcctgccttgcctaggtgggaaagggagtacggatcagtgaccaagggccttatgaaggataagggtgcgatgggaggtcgaaagatcatcagctttaagggtggcaaccagctacttacaaaccgcttacagcagctactcactactccggtgagattcaattgcaaggtgacagggattacagccagcaatggcgggtacatcgtgagcgctgttgaggacggcgtatctgagagctacaccgcatctcgtgtgatcttgaccacacccgcttactcagcagcggctaccataactaaccttgatgcagccactgcggcactgttgaacgaaatccattatccacgtatgggcgtgttacacttgggctttgatgcaactgccttgccacagccgctggacgggttcggatttctagtgccgaacgcggagaacatgcacttcctgggagccatctgcaatgcagccatcttcccggacaaggctccgcccggcaagatcctgtttacagtgttcctcggaggcgcacgccaggagtcgctcttcgatcagatgactcctgaggctcttcagcagcaagtcgttagtgaggtgatgagcttgttgcacttgtcagctccaccggtgatgcagcacttctcctcctggaacaaggccatccctcaattgaacgtcgggcacgtgaagttgcggcgcgcggtagaggcgttcgagaagaaataccctggaatccatctctcgggcaactacctccagggagttgcaataccagctttactccagcacgccgcagctttagctgcttctcttaagaagaac

SEQ ID NO: 549 - DNA, 1338 bp, Artificial Sequence
  Recombinant
cagcccgtcctcatcgttggagctggtctctccgggctctcaatcgcttacgaactacagaagctgcaagtcccttaccaagtgctggaggtttctggacattctggtggagtcatgaagtcactccggaaggacggatttgaactcgacgctggtgccaacaccatagccacgtctcccgagattcttgcgtactttacctcactaggtcttgagaatgagatcctccaggcgactgctacttctaaacaccgcttcttggtgcggcgaaggcaactgcacgccgtgagcccgcacccgttcaagatcatgtcatcgccgtacctctgccgtggctccaaatggaggctctttactgagcggtttcggaaacccgtcgtcgcttcgggcgaggagaccgtcaccgatttcatcacgaggagattcaaccgcgaaatagcggagtatgtgttcgaccctgttctaagtgggatctacgccgggaacccggaccaaatgagtattgctgaggtgttgcctgccttgcctaggtgggaaagggagtacggatcagtgaccaagggccttatgaaggataagggtgcgatgggaggtcgaaagatcatcagctttaagggtggcaaccagctacttacaaaccgcttacagcagctactcactactccggtgagattcaattgcaaggtgacagggattacagccagcaatggcgggtacatcgtgagcgctgttgaggacggcgtatctgagagctacaccgcatctcgtgtgatcttgaccacacccgcttactcagcagcggctaccataactaaccttgatgcagccactgcggcactgttgaacgaaatccattatccacgtatgggcgtgttacacttgggctttgatgcaactgccttgccacagccgctggacgggttcggatttctagtgccgaacgcggagaacatgcacttcctgggagccatctgcaatgcagccatcttcccggacaaggctccgcccggcaagatcctgtttacagtgttcctcggaggcgcacgccaggagtcgctcttcgatcagatgactcctgaggctcttcagcagcaagtcgttagtgaggtgatgagcttgttgcacttgtcagctccaccggtgatgcagcacttctcctcctggaacaaggccatccctcaattgaacgtcgggcacgtgaagttgcggcgcgcggtagaggcgttcgagaagaaataccctggaatccatctctcgggcaactacctccagggagttgcaataccagctttactccagcacgccgcagctttagctgcttctcttaagaagaactga

SEQ ID NO: 550 - DNA, 1338 bp, Artificial Sequence
  Recombinant
cagcccgtcctcatcgttggagctggtctctccgggctctcaatcgcttacgaactacagaagctgcaagtcccttaccaagtgctggaggtttctggacattctggtggagtcatgaagtcactccggaaggacggatttgaactcgacgctggtgccaacaccatagccacgtctcccgagattcttgcgtactttacctcactaggtcttgagaatgagatcctccaggcgactgctgcttctaaacaccgcttcttggtgcggcgaaggcaactgcacgccgtgagcccgcacccgttcaagatcatgtcatcgccgtacctcagccgtggctccaaatggcggctctttactgagcggtttcggaagcccgtcgtcgcttcgggcgaggagaccgtcaccgatttcatcacgaggagattcaaccgcgaaatagcggagtatgtgttcgaccctgttctaagcgggatctacgccgggaacccggaccaaatgagtattgctgaggtgttgcctgccttgcctaggtgggaaagggagtacggatcagtgaccaagggccttatgaaggataagggtgcgatgggaggtcgaaagatcatcagctttaagggtggcaaccagctacttacaaaccgcttacagcagctactcactactccggtgagattcaattgcaaggtgacagggattacagccagcaatggcgggtacatcgtgagcgctgttgaggacggcgtatctgagagctacaccgcatctcgtgtgatcttgaccacacccgcttactcagcagcggctaccataactaaccttgatgcagccactgcggcactgttgaacgaaatccattatccacgtatgggcgtgttacacttgggctttgatgcaactgccttgccacagccgctggacgggttcggatttctagtgccgaacgcggagaacatgcacttcctgggagccatctgcaatgcagccatcttcccggacaaggctccgcccggcaagatcctgtttacagtgttcctcggaggcgcacgccaggagtcgctcttcgatcagatgactcctgaggctcttcagcagcaagtcgttagtgaggtgatgagcttgttgcacttgtcagctccaccggtgatgcagcacttctcctcctggaacaaggccatccctcaattgaacgtcgggcacgtgaagttgcggcgcgcggtagaggcgttcgagaagaaataccctggaatccatctctcgggcaactacctccagggagttgcaataccagctttactccagcacgccgcagctttagctgcttctcttaagaagaactga

SEQ ID NO: 551 - DNA, 1338 bp, Artificial Sequence
  Recombinant
cagcccgtcctcatcgttggagctggtctctccgggctctcaatcgcttacgaactacagaagctgcaagtcccttaccaagtgctggaggtttctggacattctggtggagtcatgaagtcactccggaaggacggatttgaactcgacgctggtgccaacaccatagccacgtctcccgagattcttgcgtactttacctcactaggtcttgagaatgagatcctccaggcgactgctacttctaaacaccgcttcttggtgcggcgaaggcaactgcacgccgtgagcccgcacccgttcaagatcatgtcatcgccgtacctctgccgtggctccaaatggaggctctttactgagcggtttcggaaacccgtcgtcgcttcgggcgaggagaccgtcaccgatttcatcacgaggagattcaaccgcgaaatagcggagtatgtgttcgaccctgttctaagtgggatctacgccgggaacccggaccaaatgagtattgctgaggtgttgcctgccttgcctaggtgggaaagggagtacggatcagtgaccaagggccttatgaaggataagggtgcgatgggaggtcgaaagatcatcagctttaagggtggcaaccagctacttacaaaccgcttacagcagctactcactactccggtgagattcaattgcaaggtgacagggattacagccagcaatggcgggtacatcgtgagcgctgttgaggacggcgtatctgagagctacaccgcatctcgtgtgatcttgaccacacccgcttactcagcagcggctaccataactaaccttgatgcagccactgcggcactgttgaacgaaatccattatccacgtatgggcgtattacacttgggctttgatgcaactgccttgccacagccgctggacgggttcggatttctagtgccgaacgcggagaacatgcacttcctgggagccatctgcaatgcagccatcttcccggacaaggctccgcccggcaagatcctgtttacagtgttcctcggaggcgcacgccaggagtcgctcttcgatcagatgactcctgaggctcttcagcagcaagtcgttagtgaggtgatgagcttgttgcacttgtcagctccaccggtgatgcagcacttctcctcctggaacaaggccatccctcaattgaacgtcgggcacgtgaagttgcggcgcgcggtagaggcgttcgagaagaaataccctggaatccatctctcgggcaactacctccagggagttgcaataacagctttactccagcacgccgcagctttagctgcttctcttaagaagaactga

SEQ ID NO: 552 - DNA, 1338 bp, Artificial Sequence
  Recombinant
cagcccgtcctcatcgttggagctggtctctccgggctctcaatcgcttacgaactacagaagctgcaagtcccttaccaagtgctggaggtttctggacattctggtggagtcatgaagtcactccggaaggacggatttgaactcgacgctggtgccaacaccatagccacgtctcccgagattcttgcgtactttacctcactaggtcttgagaatgagatcctccaggcgactgctacttctaaacaccgcttcttggtgcggcgaaggcaactgcacgccgtgagcccgcacccgttcaagatcatgtcatcgccgtacctctgccgtggctccaaatggaggctctttactgagcggtttcggaaacccgtcgtcgcttcgggcgaggagaccgtcaccgatttcatcacgaggagattcaaccgcgaaatagcggagtatgtgttcgaccctgttctaagtgggatctacgccgggaacccggaccaaatgagtattgctgaggtgttgcctgccttgcctaggtgggaaagggagtacggatcagtgaccaagggccttatgaaggataagggtgcgatgggaggtcgaaagatcatcagctttaagggtggcaaccagctacttacaaaccgcttacagcagctactcactactccggtgagattcaattacaaggtgacagggattacagccagcaatggcgggtacatcgtgagcgctgttgaggacggcgtatctgagagctacaccgcatctcgtgtgatcttgaccacacccgcttactcagcagcggctaccataactaaccttgatgcagccactgcggcactgttgaacgaaatccattatccacgtatgggcgtgttacacttgggctttgatgcaactgccttgccacagccgctggacgggttcggatttctagtgccgaacgcggagaacatgcacttcctgggagccatctgcaatgcagccatcttcccggacaaggctccgcccggcaagatcctgtttacagtgttcctcggaggcgcacgccaggagtcgctcttcgatcagatgactcctgaggctcttcagcagcaagtcgttagtgaggtgatgagcttgttgcacttgtcagctccaccggtgatgcagcacttctcctcctggaacaaggccatccctcaattgaacgtcgggcacgtgaagttgcggcgcgcggtagaggcgttcgagaagaaataccctggaatccatctctcgggcaactacctccagggagttgcaataccagctttactccagcacgccgcagctttagctgcttctcttaagaagaactga

SEQ ID NO: 553 - DNA, 1338 bp, Artificial Sequence; identical to SEQ ID NO: 549
  Recombinant

SEQ ID NO: 554 - DNA, 1338 bp, Artificial Sequence; identical to SEQ ID NO: 549
  Recombinant

SEQ ID NO: 555 - DNA, 1338 bp, Artificial Sequence; identical to SEQ ID NO: 549
  Recombinant

SEQ ID NO: 556 - DNA, 1338 bp, Artificial Sequence; identical to SEQ ID NO: 549
  Recombinant

SEQ ID NO: 557 - DNA, 1329 bp, Artificial Sequence
  Recombinant
atgcaaacgcaaccagtgataatcgcgggcgctggcatcgccggactttccattgcgtacgagctccagcagaagggtatcccgtacgagatcatggaggcaagttcctatgccggcggcgtcgtcaagtcactgcacatcgacgggtacgagctggacgcgggacccaacagcctagccgcttccgctgccttcatggcgtacatcgaccagctggggctccaagaccaagtcctcgaggctgccgcggcgagtaaaaatcgctttctcgtgaggaacgacaagcttcacgctgtgtcaccgcaccctttcaaaatacttcaaagcgcctacatctcgggcggtgctaagtggcggttattcacggagcgttttaggaaggccgccgctcccgaaggtgaggagactgtttcctctttcgtcacacgcaggttcggaaaggagatcaacgattatctctttgagcctgttctcagcggaatatacgccggcaacccagaccttatgagcgtcggagaggttctccctatgctgccgcaatgggagcaaaagtatggttctgtgacccaaggcctactgaagaataagggggcgatgggcggaagaaagataattgcattcaaggggggtaatgccacccttacaaatcgcctgcaaagccttttgtcgggaaaaatccgtttcaattgtgccgtcaccggtgttacaagaggcgcagatgattacatcgttcagtacaccgagaacggtaataccgccatgctaaacgcatctagggtgattttcacaaccccggcctactcaactgccgtcgccatccaagccctcgacgccagcctggccactcatctcagtgatgtgccttaccctcgtatgggggtattacatcttggcttcggggccgaagcgcgacagaaagcccccgctggatttggcttcctagtccctcacgccgccggtaaacattttcttggcgccatctgtaactccgcaatcttcccatccagagtgcctactggcaaggttctgtttactgtgttcctgggcggtgcccgccaggagcagctattcgaccaattaggcccagaaaagctccaacaaaccgttgtgaaggaactaatggagttgctcggactgacgacaccacccgagatgcagaggttttctgagtggaaccgcgcgattccacaactcaacgtcgggtacgcccagacccggcaacagataggggttttcgagcagcgctatccaggcattcgacttgctggtaattacgtcacaggagtcgctgtgccagccataatacaagctgcaaaggggtattgctga

SEQ ID NO: 558 - DNA, 1347 bp, Artificial Sequence
  Recombinant
atgtcagaccaaccagtcttgattgttggggccggcctctctggcctgtcgattgcctacgaactgcagaagctccaggtgccgtaccaagtcctggaggtgtcgggccatagcggcggtgtcatgaaatcgctgcgtaaggacggcttcgagttggacgcgggcgcgaacacaatcgcggctagcccagaaatacttgcttactttacaagtctgggtctggagaatgagatcctccaggctacagccgctagcaaacatcgattcctggtgcgcaggcgacaactgcacgccgtcagtccacatccattcaagataatgtcgagcccctatttaagccgcgggtccaagtggaggctctttactgaaagatttcgaaaaccggtcgtcgctagcggagaagaaactgttacagattttattactcgcaggttcaacagggagattgcagaatatgtcttcgatccagttctctcaggaatttacgcgggcaacccagaccagatgagcatcgctgaagtcctgcccgcgctccctcggtgggaacgagaatatggaagcgtcaccaaaggtctcatgaaggacaagggggccatgggcggtcggaagatcatatcgtttaaaggcgggaaccagcttctgactaaccggctgcaacagctgctcactacaccagtgcggtttaattgcaaagtcacaggtataacggctagtaatggcggctacattgtttcagcggtcgaagatggtgtgagcgagtcatacaccgcctcccgcgtgatccttaccacaccggcctactcggcggcagctacaatcaccaatcttgacgcggctacagccgcattactcaacgagattcattatcccaggatgggggtcctccatctgggcttcgacgcgacagctcttccccagcccttggatggcttcgggtttctggtcccgaacgccgaaaacatgcattttctcggcgccatttgcaacgccgcgatcttcccggataaggccccgcctggaaaaatattgttcactgtctttcttggcggcgcacgccaggagtccctgttcgaccaaatgaccccagaggctctgcagcagcaggtggtctctgaggtgatgtcacttctgcacctttctgcacctccagtgatgcagcacttctcaagctggaataaagctatcccccagttgaacgtcggccacgtgaagcttcgtagggcggtcgaagcgttcgaaaagaagtatccaggcattcacctgtccggcaactatctgcagggcgtcgcaatcccggcgctactccagcacgccgctgcgctagccgcgtctcttaagaagaattag

SEQ ID NO: 559 - DNA, 1413 bp, Artificial Sequence
  Recombinant
atgagtgacgggaagaagcacgttgtgataatcggaggcgggataaccggcctcgccgccgccttctatatggagaaggaaattaaggagaaaaacctcccgctagagctgacgttggtggaagcgtcaccaagggtcggcggtaagatccagaccgtcaaaaaggatggctacatcatcgagcgcggcccggacagcttcctcgagcggaagaagtccgcaccccagttagtcaaagacctcggcttggaacaccttttggtcaacaacgcgacaggtcagtcctatgtgcttgtgaatcggacgctgcacccgatgcctaagggcgctgtcatgggtatccccacgaagatcgcgccgttcgtatcgaccggcctgttctccctatcaggtaaggcccgcgctgccatggactttatcctccctgcctcgaaaactaaagacgatcagtcactaggcgagttctttcggcggcgagtgggtgacgaggtggtggagaacctcatagaacccctgctgtccgggatctacgctggagacatcgacaagctgagcctcatgtctacttttccgcaattttatcagaccgagcagaaacacagatctcttatccttggcatgaagaagaccaggcctcaggggtcgggtcaacagctcacagcaaagaagcaagggcagttccaaaccctgagcacaggcttgcagaccctggtcgaagaaattgagaagcagctgaaattaacgaaggtttacaagggaaccaaggtcaccaaacttagtcacagcggctcgggctacagcctagagcttgacaacggagtgactctggacgcagacagcgtgatcgtgacggcgccccacaaggctgcggcgggaatgctgagtgagctccccgccataagtcatctcaagaacatgcactcgacgtcggtagccaatgtcgcgttggggtttcccgagggtagcgtccaaatggaacacgaaggaactggtttcgtcatatcccggaactctgacttcgcgatcacagcgtgcacttggacgaataaaaagtggccgcacgcagcgcctgaggggaagacccttcttcgagcgtatgtgggcaaagcgggcgatgaaagcattgtggatttatcggacaacgacattatcaacatcgtactggaagacctaaagaaagtcatgaacataaacggcgaaccggagatgacatgcgtcactaggtggcacgagagcatgccgcagtaccacgtggggcacaagcagcgcatcaaggaattgagggaggccctcgctagcgcgtaccctggagtttacatgaccggcgccagttttgagggtgtcggtatccctgactgtatcgaccagggtaaggccgcggtaagcgacgcattgacgtacctgttctcatga

SEQ ID NO: 560 - DNA, 1413 bp, Artificial Sequence
  Recombinant
atgcacgacaaccagaagcatctggtcatcattggcgggggcatcacgggcttggcagccgccttctacctggagaaggaggtcgaggagaagggccttccgattcaaatatctctgattgaggcgtctccccgactcggcgggaagatccagaccctctataaagacggctatataattgagcggggaccagattctttcctggagcgaaaggtctcgggcccacagttggcgaaagatgtcggcctctccgatcaactcgtgaacaacgagaccgggcaggcctatgttctggtgaacgagaaattgcatcctatgcctaagggggccgtcatgggaataccaacccaaatatctcccttcataacaaccggactgttctcggttgccggtaaggccagggccgcgatggacttcgtcctgccaaagtctaagcagacggaggaccagtccctcggggaatttttccgccgccgggtcggcgacgaggttgtggaaaacctgattgagccgttgctgtctggcatctacgcaggcgatatcgacaggctgagccttatgtctacgttcccgcaattttatcagaccgagcagcagcaccggtctctgatacttggcatgaagaaatcacaacagcacgccaaagcacaacaggttactgctaagaagcaaggacaattccagacaatcaaccaagggttgcagtccctcgtggaggcggtagaaggcaaattgaaactcaccaccgtctacaagggcacgaaagttaagcagatcgagaaaacggatggcgggtacggtctccagctcgatagcggccagacactgttcgccgactcagcgatcgtcaccaccccccaccagtccatctacagcatgttccctaaggaggcggggttagaatacttacatgacatgacctccacctccgtcgccacagtagctctcggcttcaaggacgaggacgtgcacaacgaatacgacggtaccgggttcgtgatctcgcggaattcggacttcagtattactgcctgcacctggacgaacaagaagtggccacacacagcacccaaaggtaagaccttgctgagggcttatgtgggtaaggcgggggacgagagcatagtggagcagtctgactcgcagatcgtcagcatcgtactggaagacctgaagaagatcatggacatcaaggccgacccggagttgaccaccgtcacacggtggaaaacctcaatgccacaatatcatgtcggacatcagaaggccatctccaacatgcgcgagaccttcaagcagtcttacccgggcgtgtatatcaccggagcggctttcgagggggtcggcatccctgactgcatagaccaggggaaggcggccatcagcgaggctgtgtcgtaccttttctcgtga

SEQ ID NO: 561 - DNA, 1413 bp, Artificial Sequence
  Recombinant
atgcatgacaaccagaagcacctggttatcattggcggtggcataaccgggctcgccgccgccttttacctggagaaggaggtggaggaaaaaggcctcccaatccagatcagtttgatagaggcgagtccgcgcttggggggcaagatccagactctgtataaagatggatacattatcgagaggggtccagacagcttcctggagcgcaaggtctccgggcctcagttggcgaaggatgttgggttgtcagatcagctcgtgaacaacgaaacgggccaggcgtatgtgttagtcaatgaaactctgcaccccatgcccaagggcgcggtgatggggatacccacccagatcagtcccttcatcacaaccggtctgttctcggtcgcagggaaggcccgagcggcgatggattttgtcctgcccaagtcgaagcagaccgaggaccagagcctcggggagtttttcaggcgcagagttggcgatgaggtcgtcgagaacctcattgagccgcttctcagcgggatttatgcgggagacatcgacaggctctccctgatgtcaacttttccgcagttctaccagacggagcaaaagcacaggagcctgattctgggaatgaagaagtcacaacaacatgctaaagcccagcaggtaactgcaaagaagcagggtcagttccaaacaatcaatcaaggtctccaggcactcgtcgaggccgtggagtcaaagctaaagctgaccaccatatacaagggtaccaaagtgaaacaaatcgagaagacagacggcggttacggagtgcagcttgactccggccagaccctcctcgccgactctgcgatcgtgaccacgccgcaccagtccatctactctatgttccccaaggaggccgggctcgaatatttgcacgatatgaccagcaccagcgtcgctacggtagcactcgggttcaaggaggaggacgtccacaacgagtacgatggcactggcttcgtgatcagccgtaactctgatttcagcatcactgcatgcacatggactaataagaaatggccccacactgcacccaagggcaagacgctgctgcgagcctacgtcgggaaggccggggacgagtctattgtagagcagagcgatcaccagattgtgagtatcgtactggaggacctgaaaaagatcatggatataaaggcggacccagagctgactaccgtgacccgctggaaaacatccatgccgcaataccatgtgggccaccaaaaagcgatctccaacatgcgggagacgttcaagcaatcttatcccggcgtgtacatcacgggagccgcgttcgagggcgtgggcatcccggattgcatcgatcagggtaaggctgcgatatcggaggctgtcagttacctgttttcttag

SEQ ID NO: 562 - DNA, 1434 bp, Paenibacillus macerans
gtgagcaaaaaaatcgccgtcatcggcggaggcataaccgggttaagcgtggcttattacgtgcgtaaattgctgcgtgaacagggggtaaacgctggggttaccctcgtggaacagtccgatcggctgggcggcaaaatccgttccctacgacgtgacggctttacgatagaacagggcccggattcaatgatcgcgcgcaagcccgccgcgctggaattgatccgggaactcgggctggaggataagctggcgggaacgaatccgcaggcgaagcgaagttatatattgcatcgcggcaaattccatcccatgccgccggggctgatgctcggcataccgacgcaaatgtggccgatggtcaagacggggctgctctctccggccggcaagctgcgggccgcgatggatctgctgcttcccgcgcggcgcggcggcggcgacgaatcgctcggcggcttcatccgccgccggctcggcagagaagtgctggagcagatgacggagccgcttctagccggcatatatgccggggacaccgaacagcttagcttgaaagcgacgtttccgcagtttatggagatggagcgcaagcaccgcagcctgatccttgggctgctggccggcaaaaagcagccgccgcggccggggggaagccaggtcccgctgccgaaggccgcgcaaaccagcatgtttctgacgttgacgggcggtttggagggactgacggaagcgctggaggaatcgctaagcgaagagaaaataattaccggccaggcggtaaccggactgtcgcagcaagaggcgggttatgagcttaacttaagcgggggcgagcgtttgaacgcggacggagtcattttggcagttcctgcttttgctgcggcccggctattggatggcgttcccgaagccgcttacctggagcggatccgttatgtgtccgtggccaatttagccttcgcctaccggcgggaagacgttccgcacgatttgaacggctccggcgtgcttatcccgcgcggggaggggcgaatgattacggccattacctgggtttcttcgaaatggctgcattcggctcccggcgataaagcgctgctgcgagcctatatcggccgcctgggcgacgaggcatggaccgcgatgtgcagggccgacatcgagcgccgggtggccgccgagctgcgcgatttgctgggcatcgccgccagcccgctgttttgcgagctcgccgctttgccggagtcgatgccccaatatccggtcgggcatgtcgagcggcttgaggcgctgcgcggggcattgtgccgggcgaagccggggctgctgctgtgcggcgcgggatatgccggcgtaggcattcccgactgcatccggcagggcaaggaagccgctgaaagcatggcggcttatttgagggatggacggtga

SEQ ID NO: 563 - DNA, 1482 bp, Paenibacillus thiaminolyticus
atgaaagctctgcggaaacttgtcgttatcggtggcggaattacgggattgagcgcggcgttctatgcgctgaagcaggcggatgaagaggggcagcccatctccgttaccatcatagagcaatcggaccgtctcggcgggaagatacagaccctgcggaaggaagggtgtgtcattgagaaaggcccggactccttcctcgcccggaagctgccgatgatcgatttggcgcgcgacctcggaatggattctgaattggtcgccacgaatccgcatgccaaaaaaacatatatattgcgccggggcaagctgtaccggatgccgcccggcctcgtgctgggcatcccgacggagctggggccgttcgcgaagacagggctcatctccccgtgggggaagctgcgcgcggctatggatctgttcatcaagccgcatccggcggatgaagatgaatccgttggcgcgttcctggacagacggctcggacgcgaagtgacggagcatattgccgagccgctgcttgccggcatttatgccggagatttgcaggcgctgagcctgcaggccaccttcccgcagttcgcgcaggtggagcggaagcacggtggcctgatacgcggaatgaaggcgagccgccaagcaggccaatcggtaccggggctgccggatgtcgccaaaggaacgatgttcctgacattccgcaacggcttgacctcgctcgtcgaacggctggaggagacgctgcgggaccgggccgaattgtgccttggcatcggcgcggaaggattcgagaagcgggaggacggaacgtatctggtgcgcttgagcgatgggagcaggctgcaggcggatgccgtcatcgtgacgacgccttcgtatcatgcggcatccttgctcgaggagcatgtcgatgcgagcgccttgcaggcgatccgtcatgtatccgtcgcgaatgtcgtcagcgtgttcgatcgcaagcaggtcaataatcagttcgacggcacagggttcgtcatctcgcgccgggaaggccgggcgattacggcctgcacgtggacctcggtgaagtggccgcatacgagccgcggggacaagcttattatccgctgctacattggccgggccggtgacgaggaacgggtggactggccggacgaggcgctcaagcggacggtgcgcagcgagctgcgggagctgcttgatatcgatatcgacccggagttcgtcgagattacgcgccttcgccactcgatgccccagtatccggtcggccatgtgcaggcgatccgctcgctgagggacgaggtggggcgcacgctcccaggcgtgttcctggcaggacagccgtacgaaggggtcggcatgcccgattgcgttcgcagcggccgcgatgcggcggaagccgcggttagcgcgatgcaggccatgagtacggagccagaggcgccagccgaggatgccgctactggaacggcggggtaa

SEQ ID NO: 564 - DNA, 1425 bp, Paenibacillus polymyxa
atgggtgataagaaacgccgtgttgttgttgtcggcggtggccttaccggcctcagcgcggcattttatatccgcaagcattaccgggaagcaggagttgaacctgtgattactttggtcgagaaaagctcgtccatgggaggcatgattgagacactgcaccgggatggatttgtgattgaaaaagggcccgattcgttcctggctcgcaaaacggcaatgattgatctggccaaagaattggagatcgatcatgagctggtaagtcagaatccggagtcgaagaaaacgtatatcatgcagcgtggcaagcttcatcctatgccagcaggacttgttctcggtattccgacagaactaagaccattcttgagaagtggtttggtttctccggcaggcaaactgcgggcgttgatggattttgtcatcccgccgcgtcgtacaacagaggatgaatcgctcggttatatgattgaacgccgtcttggagcagaagtgctggagaacttgacggaaccactgctcgcaggaatctatgcaggtgatatgcggcgattgagcctccaggctaccttcccgcagttcggagaagtagagcgcgattacggcagcttgatccggggcatgatgacggggcgcaaaccggctgagacgcataccggaacaaaacggagcgcttttttgaactttcgccagggacttcagagccttgttcatgcactcgtccatgagttgcaggatgtggatcaacgtctgaacactgcggtgaaatcgctgcaacgccttgatggagcgcagaccagataccgtgttgaacttggtaatggcgaaatgcttgaagccgatgatgtagtggttactgtgccgacatatgtcgcgtcggagctgttgaagcctcacgtggacacagcggcactggatgcgattaactatgtgtctgtagccaatgtagtgctcgcttttgagaaaaaagaggtggagcatgtattcgacggatcgggtttcctcgttccgcggaaagagggtcggaatattacggcttgcacgtggacatcgacgaaatggctgcataccagcccggatgataaagtactgcttcgctgttatgttggtcgctccggtgacgaacagaacgtagagcttccggatgaagcgctgacgaatctcgttctcaaagatctgagagagacgatgggtattgaagcagtgccgatcttctccgagattacaaggcttcgtaaatccatgccacagtatccggtgggacaccttcaacatattgccgctctccgtgaggagcttggcagcaaattaccgggtgtgtacattgcaggtgcaggttatgagggcgtaggcttgcctgattgcatcagacaagcgaaggaaatgtctgttcaggctacacaagagcttgcagcagattaa

SEQ ID NO: 565 - DNA, 1413 bp, Bacillus atrophaeus
atgagtgacggcaaaaagcatcttgtcatcatcggcggcggcatcacgggattggcctccgccttctatatggaaaaagaaatcagagagaaaaatttgcctctttctgtgacgttagtcgaagcaagcccgagagttggcgggaaaattcaaacggcccgcaaggacggttatattattgaaagagggccggactcatttttagaaagaaaaaaaagcgcaccggagcttgtcgaagatttaggccttgagcatttgcttgtcaacaatgcgacggggcagtcttatgtgctggttaacgaaacgcttcacccgatgccaaagggcgctgttatgggcatacctactaaaatagcgccatttatgtctaccggcttattttcattttccggcaaagcgcgcgcggctatggatttcgttttgcccgcaagcaagccgaaggaagatcagtccctgggtgaattcttccgcaggcgtgtcggtgacgaagttgttgaaaatttgattgagccgctattatccggcatttatgcgggtgacattgacaggctcagcctgatgtcgacgttcccgcagttttatcagaccgaacaaaagcacagaagcttgatcctcggcatgaaaaaaacaaggcctcagggctccggacagcggttaacggctaaaaaacaagggcaattccaaaccttaaagaccggcttgcagacactcgtcgaagagctggaaaaccagctgaagctgacgaaggtatacaagggtacaaaagtaaccaatatcagccgcggggaaaagggctgctccatcgctcttgataacgggatgacgctggatgccgatgcagcgattgtaacctcaccgcacaaatcggctgccggaatgtttccggatctgccagctgtcagtcagttaaaagacatgcactctacctctgtggcgaatgtcgcgcttggctttccacaagaggctgtccaaatggaacatgaaggaacgggttttgtcatctcaagaaacagtgatttttcaataacggcctgtacttggacgaataaaaaatggccgcactctgctccggaaggcaaaacgctcctcagggcttatgtcggaaaagcgggtgatgaatcaatcgtcgaactgtctgataatgagattatcaaaattgtattagaagacctaaagaaagtcatgaaaatcaaaggcgaacctgaaatgacgtgcgtcacacgctggaatgagagtatgccccaatatcatgtcggccacaaacagcgtataaaaaaagtgcgcgaagcactggctgcttcctatccgggagtttacatgacgggcgcttcattcgaaggcgttgggattccggactgtatcgatcaagggaaaagcgccgtttcagacgtacttgcttatttattcggttga

SEQ ID NO: 566 - DNA, 1413 bp, Bacillus atrophaeus
atgagtgacggcaaaaagcatcttgtcatcatcggcggcggcatcacgggattggcctccgccttctatatggaaaaagaaatcagagagaaaaatttgcctctttctgtgacgttagtcgaagcaagcccgagagttggcgggaaaattcaaacggcccgcaaggacggttatattattgaaagagggccggactcatttttagaaagaaaaaaaagcgcaccggagcttgtcgaagatttaggacttgagcatttgcttgtcaacaatgcgacggggcagtcttatgtgctggttaacgaaacgcttcacccgatgccaaagggcgctgttatgggcatacctactaaaatagcgccatttatgtctacccgcttattttcattttccggcaaagcgcgcgcggctatggatttcgttttgcccgcaagcaagccgaaggaagatcagtccctgggtgaattcttccgcaggcgtgtcggtgacgaagttgttgaaaatttgattgagccgctattatccggcatttatgcgggtgacattgacagactcagcctgatgtcgacgttcccgcagttttatcagaccgaacaaaagcacagaagcttgatcctcggcatgaaaaaaacaaggcctcagggctccggacagcagttaacggctaaaaaacaagggcaattccaaaccttaaagaccggcttgcagacactcgtcgaagagctggaaaaccagctgaaactgacgaaggtatacaagggtacaaaagtaaccaatatcagccgcggggaaaagggctgctccatcgctcttgataacgggatgacgctggatgccgatgccgcgattgtgacctcaccgcacaaatcggctgccggaatgtttccggatctgccagctgtcagccagttaaaagacatgcactctacctctgtggcgaatgtcgcgcttggctttccacaagaggctgtccaaatggaacatgaaggaacgggttttgtcatctcaagaaacagtgatttttcaataacggcctgtacttggacgaataaaaaatggccgcactctgctccggaaggcaaaacgctcctcagggcttatgtcggaaaagcgggtgatgaatcaatcgtcgaactgtctgataatgagattatcaaaattgtattagaagacctaaagaaagtcatgaaaatcaaaggcgaacctgaaatgacgtgcgtcacacgctggaatgagagtatgccccaatatcatgtcggccacaaacagcgtataaaaaaagtgcgcgaagcactggctgcttcctatccgggagtttacatgacgggcgcttcattcgaaggcgttgggattccggactgtatcgaccaagggaaaagcgccgtttcagacgtacttgcttatttattcgaatga

SEQ ID NO: 567 - DNA, 1434 bp, Artificial Sequence
  Recombinant
atgtcaaagaagattgcagtcattggtggtgggataacagggttgtccgtggcctactacgtgaggaagctgcttcgggagcaaggcgttaatgcgggcgttaccctcgtcgagcaatccgaccgcctcggcgggaagattagatccttgagacgagacggctttaccattgagcaaggccctgactctatgattgcacgtaagcccgcagctctcgaacttatccgtgagcttggtctggaggacaagttggcgggcacaaaccctcaagccaaacgctcctacatactgcaccgtggcaagtttcatccgatgccacctgggctgatgctcgggattcccactcaaatgtggccaatggtcaagaccgggctgctatctccggccggaaagctacgggctgcgatggacctacttcttcctgcaaggcgcggaggcggcgacgaatcacttggtgggtttatccggaggcggcttggacgtgaggtgttggagcagatgaccgaaccactccttgctggaatctatgctggcgacacagaacagctttcacttaaagcgacctttcctcaattcatggagatggaaaggaaacatcgcagtctcatccttggactattggctgggaagaaacagccaccgcgtcccggtggtagccaagtgccgctcccaaaggccgctcagaccagtatgttcttgacactcaccggcgggttggaaggtctgaccgaagcactagaggaaagcctatcagaggagaagataattactggccaagcagttaccggactttcgcagcaagaggccgggtatgagttaaatctctctggcggagagagacttaatgcagacggagtgatcctcgcagtcccagcgttcgctgccgcccgacttcttgacggcgtgcctgaggccgcctacctagagcgcatccgctatgtcagtgttgctaatttggcgttcgcttacaggcgtgaggacgtgcctcatgatctgaatgggtccggcgtgttaatccctagaggtgaagggaggatgattacggccataacttgggtttcgtccaaatggttgcattcagcacccggtgacaaggcactgctgagagcgtacattgggcgactaggtgatgaggcttggacagccatgtgtagggccgacatcgagcgtagagtcgccgctgaactccgcgatctactaggaattgccgctagtcctttgttctgtgaactagccgcactcccagaatctatgccgcagtatccagtgggtcacgtcgaacgactcgaagccttgcgaggagcattgtgtcgcgctaaaccagggttgttgttgtgtggtgccgggtacgctggcgttggcattccagactgcattcggcaaggcaaagaagccgctgagtcgatggcggcttatttgagggacggacgctag

SEQ ID NO: 568 - DNA, 1482 bp, Artificial Sequence
  Recombinant
atgaaggctctgaggaaacttgtggtcatcggcggagggatcactgggctttcggccgccttctatgcactaaagcaagccgatgaggaagggcagcccatctcggtcaccataattgaacagagcgataggctcggcggaaagatccagacactccgcaaggagggctgcgtaattgagaagggcccggattccttcctcgctaggaagttgccgatgattgatctagctcgggatcttggcatggactccgaattggtggcgactaatccgcacgcaaagaagacttacatcttgaggcgcggaaagctctaccggatgcctccaggcttagtgcttggcatacctacggaactaggaccattcgctaagacagggctcattagcccttggggcaaactccgcgccgctatggatttgttcattaagcctcatccagccgatgaagacgaaagtgttggcgctttcctggacagacgtctcggtagggaagtgaccgagcacattgcggaacctttattggcgggcatctacgcgggcgacttgcaagccttaagccttcaagccactttcccacagtttgcacaagtagagcgcaagcacggagggctgatacgcggtatgaaggccagcagacaggccggtcagtccgtgcctgggctgccggacgtcgccaagggtacgatgttccttacctttcgcaacgggcttaccagcttagttgaaaggttggaggaaactctcagagacagggctgaactctgtctgggcatcggcgcagaagggtttgagaaacgtgaagatggaacataccttgttcgactaagcgatggttcgaggctccaggccgacgcagtaattgtcactacgccgagctatcatgcggcatccctgttggaggagcatgtggatgcttcggccctccaggccattcgtcatgtaagcgttgcaaatgtcgttagcgtcttcgaccgaaagcaagtgaataaccagttcgacggcacagggtttgttatctcacggcgagaaggtcgcgcaatcaccgcctgtacctggacatccgtgaaatggccgcatacttcgcgcggcgacaaactgattatccggtgctacatcggtagggctggcgacgaggagcgagtggattggcccgatgaagctctcaagcgtactgtaagatcagaactgcgtgagttgctggacattgacattgatccggaatttgtggagattacacgactcaggcactctatgcctcaatacccagtcggccacgtccaggctatccgctctttgagggacgaggtcggtaggactttaccgggcgtgttccttgctgggcaaccctacgaaggtgtgggaatgcctgactgtgtgaggtccggccgggatgccgccgaagcagcagtaagtgctatgcaagcaatgagtacagaaccagaagcaccggcagaggacgccgctactggaacggcgggttga

SEQ ID NO: 569 - DNA, 1425 bp, Artificial Sequence
  Recombinant
atgggagacaagaagcggagagttgttgttgttggcggcggcttgactggcctaagcgccgccttctacatccggaaacattatcgagaagctggagttgagcccgtcatcacgcttgttgagaaatctagctcgatgggagggatgattgagacccttcatagggacgggtttgtcatcgagaagggcccggacagtttcttggcacggaagaccgcaatgattgatctggcgaaagagctggagattgaccacgagttggtcagccagaatccagaatcgaagaagacctacataatgcaacgtggaaagctgcaccctatgccagcgggacttgttctgggcattcccaccgaattgcgtccctttctccggagcgggcttgtctcacccgctgggaagttgcgggcgctgatggacttcgtaataccgccacgaaggacgaccgaagatgagtcactcgggtacatgatcgagcgccgactgggtgccgaggtgttggagaacctcacagagccgttgctcgctggaatctacgctggcgacatgagaagattgtccctccaggctacgtttccgcagttcggtgaggtggagcgcgactacggctccttaatcagaggaatgatgaccggacgtaagcctgcggagacacacacagggaccaagaggtctgcctttctcaatttcagacagggtctgcaatcactggttcacgccttagtccatgaactccaggatgtagatcagaggttaaatactgcggtgaagtcgcttcagaggcttgacggcgcacaaacccgttatcgcgttgaactcggcaatggcgaaatgcttgaggctgacgacgtggtggttactgtaccaacctacgtggcgagcgagcttcttaagccgcacgtggacacggcggcgttagacgctattaactatgtgtcggtggctaatgtagttcttgcattcgagaagaaggaagtagagcacgtcttcgatggatcgggcttcttggtgcctcggaaggagggaaggaacataaccgcctgcacctggacttcgaccaagtggctccacacatcaccagatgacaaggttctgttacgttgttacgtgggcagaagtggagatgagcagaatgtggaactcccggatgaggcactcactaatctggtgcttaaggatctgagagagacgatgggcatcgaggcggttccaatcttctcagagattacccggctccgcaagtcaatgccgcagtacccagtaggacatctccagcacatcgccgcattgcgcgaggaactcggctctaagctaccaggagtgtacatcgccggagcgggctacgagggcgttggtcttccggattgcattcgccaggccaaagaaatgtcagtccaggcaacgcaagaactcgctgccgactga

SEQ ID NO: 570 - DNA, 1413 bp, Artificial Sequence
  Recombinant
atgagtgacgggaagaagcacttggttataatcggggggggaataaccggcctggccagcgctttctatatggagaaggagatccgggagaagaacttacctctcagcgtgaccttggtggaggcatccccgcgggtaggggggaagatccagactgctcgaaaggacggctatatcatagagcggggcccggacagcttcctggagcgcaagaagtcggcgcccgagttagtcgaggacctcggtctcgagcacttactcgtaaacaacgctacagggcagtcttacgtcctcgtcaacgaaacactgcacccgatgcccaaaggcgcggtgatgggaatccccactaagattgcacctttcatgtcgactggccttttcagcttcagtgggaaggcgagggcggcaatggacttcgtcctgcccgcgtccaagccgaaggaggatcagagcctcggcgagtttttccgcaggcgagttggggatgaggtcgtggaaaacctcattgagcccttgctatccggaatctatgccggagacatcgacaggctcagccttatgtctactttcccccagttctaccagacagagcaaaagcaccgaagtttgatcctcgggatgaagaagacgcgtcctcagggttctggtcagaggctaacagcaaagaagcagggtcaattccagacgcttaaaacagggcttcaaacacttgtggaggaactcgagaatcagcttaaactaaccaaagtgtacaagggcacgaaggtaactaacatcagccgcggtgaaaagggctgcagcatcgcacttgacaacgggatgacactggacgcggacgcagcaatcgtcacgagcccccacaaatcagcggcgggaatgttccccgaccttccggcggtcagccagctgaaagacatgcactccacctccgtcgcaaacgtcgcgctcggcttcccgcaggaggctgtccagatggagcatgaggggactggcttcgttatcagcagaaattcggacttcagtatcacagcgtgcacttggacaaacaagaaatggcctcacagcgcacctgaggggaagacacttttgcgagcgtacgtggggaaagctggggacgagtccatagttgaactaagcgacaacgagataattaagatcgtgcttgaggaccttaagaaagtgatgaagataaagggcgagcccgaaatgacatgcgtaactagatggaatgagtccatgccacagtaccacgtcgggcacaagcagcgtatcaaaaaggtcagggaggctttggcggcctcatacccgggcgtatacatgaccggtgcatccttcgagggggtggggataccagactgcatcgaccaaggcaaatccgcagtctcagacgttttggcatacttgttcggctag

SEQ ID NO: 571 - DNA, 1413 bp, Artificial Sequence
  Recombinant
atgtcggatggcaagaagcacctcgtcatcatcggcgggggtatcaccggacttgcgtccgcgttctacatggagaaggagatcagggagaagaacttgcccctctcagtgaccctggtggaggcctcgccccgtgttggtggtaagatccagacagcgcgaaaagacggctacattatcgagcgggggcccgactccttcctcgagaggaagaagtctgcccccgagcttgtggaggacttggggcttgagcacctcctcgtgaacaatgcgaccgggcagagctacgttttggtgaacgagaccctgcacccgatgcccaagggagccgtgatggggatccctaccaagatcgcgcctttcatgagcactcgacttttttcattcagcggcaaggccagagccgctatggactttgttctcccggcttctaagcctaaggaagaccagagtctaggcgaattcttcaggcgaagagtcggcgatgaggttgttgagaaccttatagagccattattgtcaggtatatacgcaggagacattgacaggctgtctctcatgagtaccttccctcaattctaccagacggagcagaaacacaggagcctcatattggggatgaagaagacgcgtcctcaaggaagcggacagcagttgacggccaagaagcagggccagttccaaacgctcaagaccggacttcagaccctcgtcgaggagcttgagaaccagctaaagttgacgaaggtttacaagggcactaaggtcacaaacatctcgaggggcgagaagggatgcagcatcgcgttagacaacgggatgaccctagacgctgacgcagctattgtgactagcccccataagtccgcagccggcatgtttccagacttgccggccgttagccagttgaaggacatgcactcgaccagcgtggcaaacgtcgcattgggcttcccacaggaggcggtgcagatggagcatgaggggaccggattcgtgatctcaaggaattccgatttctccattacggcatgtacctggacaaacaaaaaatggccccacagcgccccagaagggaaaacactcctacgcgcttatgttggcaaggccggcgatgagtcaattgtggagctctccgacaatgagatcatcaaaatcgttcttgaagatcttaagaaggtaatgaagattaagggggaaccggaaatgacgtgtgtgacaaggtggaacgagagtatgccccaatatcacgtgggccacaagcagaggataaagaaggtgagggaggcgttggcggcgtcttaccccggcgtgtacatgacgggggcttcattcgagggggtgggcatccccgactgcattgaccaaggcaaaagcgcggtgtctgacgtgctcgcgtacctgttcgagtag

SEQ ID NO: 572 - DNA, 1413 bp, Artificial Sequence
  Recombinant
atgtccgacgggaagaagcacctggtaatcatcggtggtgggatcaccggtctggcttcagcgttctacatggaaaaggagatccgggagaagaacttgcccctttcggtgactctagtggaggcctctccacgggtggggggcaagattcagaccgcgcgcaaggatggctacatcatagagcgaggaccagactcattcctagagcgtaagaagtccgccccagagctcgtcgaggatctcggtctagagcacttgctagtgaataacgctacaggacagtcctacgtgctcgtgaacgagacactacacccgatgcctaagggggctgtcatgggtataccgaccaagatcgccccgttcatgtccactcgccttttctcgttctcgggcaaagctcgggccgctatggatttcgtcttgcctgcctcgaaaccgaaggaggaccagtccttaggagagttcttccgccggagggtcggcgacgaggtggtggagaacttaatcgaacccttgctctcggggatctacgctggagacattgatcgactatcgcttatgtctacgtttcctcaattttaccagacggagcagaagcaccgtagcctcattttgggtatgaagaagacacggcctcaaggttcggggcagcagcttactgccaagaagcagggccaattccagacactcaagaccggcttgcagactctagtggaggagctggagaatcaattgaagctgacaaaggtctacaagggtaccaaggtgacaaacatatcgcgtggcgaaaagggatgctccattgccctcgacaacggtatgaccctcgacgccgacgcagcgattgtgacgagcccacacaagagcgccgcgggcatgttcccggacttgcctgcagtgtcacagctgaaagacatgcattctacatccgtcgccaacgtcgccctgggctttccccaggaggctgtgcagatggagcacgaggggacgggcttcgttatcagccgcaactccgacttttctattaccgcgtgcacatggaccaacaagaagtggccgcacagcgctccggaggggaaaacacttctccgagcatacgtaggcaaggccggggacgagtcaattgttgagctctccgacaatgaaatcattaaaatagttctggaggatcttaagaaggtaatgaagataaagggggaacctgaaatgacgtgtgttacccgctggaatgagtcaatgccccagtaccatgtgggacacaagcagaggataaagaaggtgagggaggcgctcgctgcgtcctacccaggggtctacatgacaggagcgagttttgagggggtgggtattcccgactgtatcgaccagggtaagtcggcagtgtctgacgtgctcgcttacctattcgagtag

SEQ ID NO: 573 - DNA, 1434 bp, Artificial Sequence
  Recombinant
atgtcgaagaagatcgccgttatcggtggaggcattacagggctctcggtcgcctactacgtgcgtaagctgcttcgtgagcaaggcgtcaacgctggtgtgacgctggttgagcagtctgatcgcctcggtggaaaaatccgtagccttcgcagagacgggttcacgattgaacaaggaccagattccatgatcgcgcgcaaacccgcggcgttggagctaattcgagaactcggactcgaggacaagctcgccggcactaacccacaggcaaagcggtcgtacatccttcaccgcgggaagttccacccgatgcccccaggcctgatgctcggcatcccgacccagatgtggccgatggtcaagaccgggctcctgtctcccgcggggaaactaagggccgctatggacctcctcctccctgctcggaggggcggcggtgatgagagtctcgggggatttatcaggcggagattaggccgcgaggtacttgagcaaatgaccgaaccactgctcgcaggtatctatgcaggcgatacggaacaactgtccttgaaagcaacatttccacaattcatggagatggaaagaaaacataggtccctcatactcggtcttcttgctggaaaaaagcaacctccgagacccggtggttcacaagtgcctctgcctaaagcggcgcaaacttcaatgttcctgactctgacaggcgggctcgaaggccttaccgaagctctagaggaatccttgtctgaggaaaaaataatcaccggccaggctgttaccgggcttagccaacaggaagccggttatgaactgaacctttcaggtggagagaggttgaacgccgatggggtcatattggctgtaccggcgttcgccgcggctcgcctgctggacggcgtccctgaggccgcgtatttggagcgcatacgctatgtttctgttgcgaacctcgcttttgcatatagacgggaagatgtgccccatgatcttaatggttccggagtgttgatcccacgcggggagggtcgaatgataacggcaattacttgggtttccagcaagtggttacattcggctcctggggataaagctcttttgcgggcatacatcggacgtctcggcgacgaagcctggacggccatgtgcagagccgacattgagcgacgggtcgctgcagagctgagagacttgttgggcatagctgcatctccattgttctgcgagctggctgcattgcctgaaagcatgccgcaatatccagtagggcatgtggagcgcctcgaagctctccgaggcgcgttgtgtagggcgaaacctggactgctgctctgcggtgccggctatgcaggtgtgggaattcctgactgtatcaggcaaggtaaagaagcggcagagtccatggccgcttaccttagggatgggcgctag

SEQ ID NO: 574 - DNA, 1482 bp, Artificial Sequence
  Recombinant
atgaaggcgctgcggaagctggtggtaatcgggggggggatcacggggctgtcggccgcgttctacgcactcaagcaggccgacgaagagggtcagccaatttccgtaacgattatcgagcaatccgatcgacttggcggcaagatacagaccctgagaaaggagggatgcgtcattgaaaagggaccagattcatttctggcgaggaagctccccatgatcgatctggcgagagacttaggcatggactcggagctggtggccacaaatcctcatgcaaaaaagacttacatcctacggcgcggtaagttgtaccgcatgccaccgggcctggtgttggggattcctaccgagttaggacccttcgcgaaaaccggactcatcagcccctgggggaaacttcgagccgcgatggaccttttcatcaaaccacatccagccgatgaagatgagtctgtgggagcttttttagatagacgtttaggtcgcgaggtgacggagcacatcgcagagccgctgctcgccgggatatacgcaggcgatcttcaagctttgtccttgcaagctacgttccctcagttcgcgcaagtggaacgcaaacacggaggtctcatcagaggtatgaaagcgtctcgccaagctggacagtcagtcccagggctcccagatgtggccaagggtaccatgtttcttactttcagaaatggtttgactagcctggtggagcgtctcgaagaaacccttcgagatagagccgagctctgtctgggtatcggtgcagaggggtttgaaaaacgggaagacggcacgtaccttgttcgattatctgatggctccagattgcaagccgacgccgttatagttaccacaccatcataccatgccgcctccctactggaggagcacgtcgacgccagcgcgttacaggctatccgccacgtatctgtagccaacgtggtgagcgttttcgataggaagcaggttaacaatcagtttgatgggacaggttttgttatctcaagacgcgaaggcagggctatcactgcttgcacttggacctcagttaagtggccgcataccagccggggggataagttgataatccggtgttacattggtcgtgcaggagatgaggagcgcgtggattggccagacgaagcgctaaagcggaccgtgagaagtgagcttcgcgagctgttagacatagacatagatcccgaattcgtggaaattacacggttgaggcactctatgccacaataccctgttggtcatgtgcaagctatacggtccctgcgcgacgaagtaggccggaccttgccgggcgtgtttcttgcgggtcagccgtatgagggggttgggatgccagattgtgtgcgttctggccgcgacgcggcagaggctgccgtatcagccatgcaagccatgtcgacagaacccgaagccccggcggaagatgcagcgacaggaactgcaggttag

SEQ ID NO: 575 - DNA, 1425 bp, Artificial Sequence
  Recombinant
atgggggataagaagaggagggtcgttgtcgtgggtgggggactgaccggactatcagccgcgttctacattagaaagcactaccgagaggccggcgtggagccggtgatcacgctggtcgagaagtcgagttcgatgggcggaatgatcgagaccctacacagggacggctttgtgattgagaagggaccagatagcttccttgcacgcaagacagccatgatcgatctcgcaaaagagctcgagatagaccacgaactggtgtctcagaacccggagtccaagaagacatatatcatgcagagaggtaaactacaccccatgccagccgggttggttctaggaatacctaccgagctccgcccgtttttgcgtagcggtctcgtgagccccgccgggaagctgcgtgcgctaatggacttcgtgatcccgcctcggcgaacgaccgaagacgaatcgctgggatacatgattgaacggcgattgggcgctgaggtgcttgaaaatcttacggagcctctgcttgcagggatttatgcgggtgatatgaggcggttgtctctccaggcaacgttcccacagttcggtgaggtagaacgcgattacggctcactgatacggggcatgatgaccggtcgcaagcctgccgagacacacaccggtacaaaaaggtcagcctttcttaatttccggcaagggttacagtcacttgttcatgcacttgtacacgaattgcaggacgtcgatcaaagacttaataccgcagtgaagagcctgcagcgcctggatggggcccaaactaggtaccgtgtggaattaggcaatggagagatgctggaggccgatgacgtggtggtcaccgtcccaacgtacgtagcttctgagctcctcaagccccacgttgacaccgcagctctggatgcaatcaattatgtgagcgtggctaatgtcgtcctggcctttgagaagaaggaagtggagcatgtgttcgacggatcagggttcttggttccgagaaaagagggcaggaatatcacggcgtgcacttggacttcgacaaaatggctccacacctccccggatgacaaagtacttctgcgatgctatgtgggccgaagtggtgatgagcagaatgtagagctccccgacgaggcactgaccaacctcgtcctcaaggacctaagggagactatgggcattgaggccgtgccaattttctctgaaataacacgcctgcgcaagtccatgccccaataccctgtgggccatcttcaacacattgcggccctgcgggaagaacttgggtctaagctgccgggcgtgtacatagcgggcgccggttacgagggtgtcgggttgcctgactgtattagacaggcaaaggaaatgtccgtgcaagcaacccaagaacttgctgctgactga

SEQ ID NO: 576 - DNA, 1413 bp, Artificial Sequence
  Recombinant
atgagtgacggtaagaagcatttggtcatcatcggcggcggcatcaccggcttagcctccgccttctacatggaaaaggagattcgggagaagaaccttcccttgtcagttaccctggtggaggcctcgccacgggtcgggggtaaaatccagacggcccggaaggatggttatattatcgagcgcggacccgactcgttcctcgagcgcaagaagagcgcacccgaactcgttgaggaccttggcctcgaacatctcctcgttaacaatgcaactggtcagtcgtacgtcctggtcaacgagacactccatcccatgcccaagggcgcggtgatgggcattccgacgaagattgccccttttatgtcgactggccttttcagcttctcgggaaaggcccgtgccgctatggacttcgtcctccctgcctcgaaaccgaaggaggaccagtctcttggagaattttttaggcgcagagtgggggacgaggttgtggagaatctgatcgaaccgcttctgagcggaatctatgcgggcgacattgaccgcctctcactcatgagcaccttcccacaattctaccagacggagcagaagcatcggtcactcatcctggggatgaaaaaaacccggcctcaaggatcaggacaaaggcttacagctaaaaagcaggggcagtttcaaactctcaagacgggcctgcagactctagtcgaggagttagaaaaccagttgaagttgaccaaggtgtacaagggcacgaaagtgacaaacatcagccggggcgaaaagggttgttcaatcgcgttggacaacggcatgaccctggacgcagacgcagcaatcgtgacatcgccccacaagagtgctgcgggcatgttccctgatctgccggcggtcagccagcttaaggatatgcactcaacctcggtggctaacgtggccttgggcttccctcaggaggccgtccaaatggagcacgaaggaaccggctttgttatcagccgtaacagtgacttctcgattaccgcttgtacctggacgaacaagaagtggcctcacagcgcgccagaagggaagaccctcctgcgagcctacgtcggcaaggctggtgacgagtcgatcgttgagttgtctgacaacgagattatcaagatcgtacttgaagatctcaagaaggtcatgaagataaagggtgaacccgagatgacttgcgttactagatggaacgagtctatgcctcagtatcacgtggggcacaagcagaggatcaagaaggtccgggaggccttggctgcctcgtatccgggagtctacatgaccggggcctcatttgagggagtcggtatccccgactgcatcgaccaaggaaagtccgccgtctctgacgtgttggcttatctattcggctag

SEQ ID NO: 577 - DNA, 1413 bp, Artificial Sequence
  Recombinant
atgagcgacggaaagaaacatctcgtgatcatcgggggcggaataacaggcctagcctcggcattctacatggagaaggagatcagagagaaaaacctcccgctctctgtgaccctggtggaggcttcaccgagagtgggcgggaagatacagacggcgcgcaaggatggctacataatagagcggggcccagattctttcctggagagaaaaaaaagcgccccggaattggtggaggacctcggcctcgaacacctcctggtgaataacgcaacagggcaaagctacgtactcgttaatgagactctccaccccatgccaaaaggggccgtgatgggaatccccacaaagatcgctccattcatgagcaccaggttattctctttctctggtaaagctagggcagccatggacttcgtcctgccagcctccaaaccgaaagaagaccaaagcctcggggaattcttccgccggagggtgggcgacgaggtggttgagaatttaattgaacctctcctctcaggtatatacgcaggggacatcgaccgcttgtcgctgatgagcacctttccgcagttctaccagacggagcagaagcatcgctcactcattcttggtatgaagaagactcgtccgcaagggtctggccagcagctgacagccaagaaacaggggcagttccaaactcttaagaccggcctacagactctggtggaggagctcgagaaccagctgaagctcacaaaggtttacaagggcacaaaggtgacaaacatctcaaggggggagaagggttgctccatcgcgctcgataacggcatgacactcgatgctgatgcggcgatagtaactagcccgcacaagtcggccgcgggaatgttccccgacctccccgcggtctcgcaactgaaggacatgcattccaccagcgtcgccaacgtagctctaggctttcctcaggaggcagtccaaatggaacacgagggcacgggtttcgtaatctcccgcaacagcgacttctcaatcactgcttgcacgtggactaacaagaagtggccgcattcggcccccgagggcaagacgcttcttcgagcatacgtgggtaaggctggtgatgagagtatcgtcgagctctcggacaacgagatcattaagatcgtgttggaggacttgaagaaggtgatgaaaatcaagggggagccggaaatgacttgcgtgactcgctggaacgagagcatgccgcagtaccacgttgggcataagcagaggataaagaaagttcgcgaagcgctggccgcgtcttaccctggagtgtatatgacgggagcctcctttgagggtgtggggatcccggactgcatcgaccagggaaagtcagctgtctccgacgtgctggcctacttattcgagtga

SEQ ID NO: 578 - DNA, 1428 bp, Artificial Sequence
  Recombinant
aagaagattgcagtcattggtggtgggataacagggttgtccgtggcctactacgtgaggaagctgcttcgggagcaaggcgttaatgcgggcgttaccctcgtcgagcaatccgaccgcctcggcgggaagattagatccttgagacgagacggctttaccattgagcaaggccctgactctatgattgcacgtaagcccgcagctctcgaacttatccgtgagcttggtctggaggacaagttggcgggcacaaaccctcaagccaaacgctcctacatactgcaccgtggcaagtttcatccgatgccacctgggctgatgctcgggattcccactcaaatgtggccaatggtcaagaccgggctgctatctccggccggaaagctacgggctgcgatggacctacttcttcctgcaaggcgcggaggcggcgacgaatcacttggtgggtttatccggaggcggcttggacgtgaggtgttggagcagatgaccgaaccactccttgctggaatctatgctggcgacacagaacagctttcacttaaagcgacctttcctcaattcatggagatggaaaggaaacatcgcagtctcatccttggactattggctgggaagaaacagccaccgcgtcccggtggtagccaagtgccgctcccaaaggccgctcagaccagtatgttcttgacactcaccggcgggttggaaggtctgaccgaagcactagaggaaagcctatcagaggagaagataattactggccaagcagttaccggactttcgcagcaagaggccgggtatgagttaaatctctctggcggagagagacttaatgcagacggagtgatcctcgcagtcccagcgttcgctgccgcccgacttcttgacggcgtgcctgaggccgcctacctagagcgcatccgctatgtcagtgttgctaatttggcgttcgcttacaggcgtgaggacgtgcctcatgatctgaatgggtccggcgtgttaatccctagaggtgaagggaggatgattacggccataacttgggtttcgtccaaatggttgcattcagcacccggtgacaaggcactgctgagagcgtacattgggcgactaggtgatgaggcttggacagccatgtgtagggccgacatcgagcgtagagtcgccgctgaactccgcgatctactaggaattgccgctagtcctttgttctgtgaactagccgcactcccagaatctatgccgcagtatccagtgggtcacgtcgaacgactcgaagccttgcgaggagcattgtgtcgcgctaaaccagggttgttgttgtgtggtgccgggtacgctggcgttggcattccagactgcattcggcaaggcaaagaagccgctgagtcgatggcggcttatttgagggacggacgctag

SEQ ID NO: 579 - DNA, 1470 bp, Artificial Sequence
  Recombinant
aggaaacttgtggtcatcggcggagggatcactgggctttcggccgccttctatgcactaaagcaagccgatgaggaagggcagcccatctcggtcaccataattgaacagagcgataggctcggcggaaagatccagacactccgcaaggagggctgcgtaattgagaagggcccggattccttcctcgctaggaagttgccgatgattgatctagctcgggatcttggcatggactccgaattggtggcgactaatccgcacgcaaagaagacttacatcttgaggcgcggaaagctctaccggatgcctccaggcttagtgcttggcatacctacggaactaggaccattcgctaagacagggctcattagcccttggggcaaactccgcgccgctatggatttgttcattaagcctcatccagccgatgaagacgaaagtgttggcgctttcctggacagacgtctcggtagggaagtgaccgagcacattgcggaacctttattggcgggcatctacgcgggcgacttgcaagccttaagccttcaagccactttcccacagtttgcacaagtagagcgcaagcacggagggctgatacgcggtatgaaggccagcagacaggccggtcagtccgtgcctgggctgccggacgtcgccaagggtacgatgttccttacctttcgcaacgggcttaccagcttagttgaaaggttggaggaaactctcagagacagggctgaactctgtctgggcatcggcgcagaagggtttgagaaacgtgaagatggaacataccttgttcgactaagcgatggttcgaggctccaggccgacgcagtaattgtcactacgccgagctatcatgcggcatccctgttggaggagcatgtggatgcttcggccctccaggccattcgtcatgtaagcgttgcaaatgtcgttagcgtcttcgaccgaaagcaagtgaataaccagttcgacggcacagggtttgttatctcacggcgagaaggtcgcgcaatcaccgcctgtacctggacatccgtgaaatggccgcatacttcgcgcggcgacaaactgattatccggtgctacatcggtagggctggcgacgaggagcgagtggattggcccgatgaagctctcaagcgtactgtaagatcagaactgcgtgagttgctggacattgacattgatccggaatttgtggagattacacgactcaggcactctatgcctcaatacccagtcggccacgtccaggctatccgctctttgagggacgaggtcggtaggactttaccgggcgtgttccttgctgggcaaccctacgaaggtgtgggaatgcctgactgtgtgaggtccggccgggatgccgccgaagcagcagtaagtgctatgcaagcaatgagtacagaaccagaagcaccggcagaggacgccgctactggaacggcgggttga

SEQ ID NO: 580 - DNA, 1410 bp, Artificial Sequence
  Recombinant
cggagagttgttgttgttggcggcggcttgactggcctaagcgccgccttctacatccggaaacattatcgagaagctggagttgagcccgtcatcacgcttgttgagaaatctagctcgatgggagggatgattgagacccttcatagggacgggtttgtcatcgagaagggcccggacagtttcttggcacggaagaccgcaatgattgatctggcgaaagagctggagattgaccacgagttggtcagccagaatccagaatcgaagaagacctacataatgcaacgtggaaagctgcaccctatgccagcgggacttgttctgggcattcccaccgaattgcgtccctttctccggagcgggcttgtctcacccgctgggaagttgcgggcgctgatggacttcgtaataccgccacgaaggacgaccgaagatgagtcactcgggtacatgatcgagcgccgactgggtgccgaggtgttggagaacctcacagagccgttgctcgctggaatctacgctggcgacatgagaagattgtccctccaggctacgtttccgcagttcggtgaggtggagcgcgactacggctccttaatcagaggaatgatgaccggacgtaagcctgcggagacacacacagggaccaagaggtctgcctttctcaatttcagacagggtctgcaatcactggttcacgccttagtccatgaactccaggatgtagatcagaggttaaatactgcggtgaagtcgcttcagaggcttgacggcgcacaaacccgttatcgcgttgaactcggcaatggcgaaatgcttgaggctgacgacgtggtggttactgtaccaacctacgtggcgagcgagcttcttaagccgcacgtggacacggcggcgttagacgctattaactatgtgtcggtggctaatgtagttcttgcattcgagaagaaggaagtagagcacgtcttcgatggatcgggcttcttggtgcctcggaaggagggaaggaacataaccgcctgcacctggacttcgaccaagtggctccacacatcaccagatgacaaggttctgttacgttgttacgtgggcagaagtggagatgagcagaatgtggaactcccggatgaggcactcactaatctggtgcttaaggatctgagagagacgatgggcatcgaggcggttccaatcttctcagagattacccggctccgcaagtcaatgccgcagtacccagtaggacatctccagcacatcgccgcattgcgcgaggaactcggctctaagctaccaggagtgtacatcgccggagcgggctacgagggcgttggtcttccggattgcattcgccaggccaaagaaatgtcagtccaggcaacgcaagaactcgctgccgactga

SEQ ID NO: 581 - DNA, 1398 bp, Artificial Sequence
  Recombinant
aagcacctggtaatcatcggtggtgggatcaccggtctggcttcagcgttctacatggaaaaggagatccgggagaagaacttgcccctttcggtgactctagtggaggcctctccacgggtggggggcaagattcagaccgcgcgcaaggatggctacatcatagagcgaggaccagactcattcctagagcgtaagaagtccgccccagagctcgtcgaggatctcggtctagagcacttgctagtgaataacgctacaggacagtcctacgtgctcgtgaacgagacactacacccgatgcctaagggggctgtcatgggtataccgaccaagatcgccccgttcatgtccactcgccttttctcgttctcgggcaaagctcgggccgctatggatttcgtcttgcctgcctcgaaaccgaaggaggaccagtccttaggagagttcttccgccggagggtcggcgacgaggtggtggagaacttaatcgaacccttgctctcggggatctacgctggagacattgatcgactatcgcttatgtctacgtttcctcaattttaccagacggagcagaagcaccgtagcctcattttgggtatgaagaagacacggcctcaaggttcggggcagcagcttactgccaagaagcagggccaattccagacactcaagaccggcttgcagactctagtggaggagctggagaatcaattgaagctgacaaaggtctacaagggtaccaaggtgacaaacatatcgcgtggcgaaaagggatgctccattgccctcgacaacggtatgaccctcgacgccgacgcagcgattgtgacgagcccacacaagagcgccgcgggcatgttcccggacttgcctgcagtgtcacagctgaaagacatgcattctacatccgtcgccaacgtcgccctgggctttccccaggaggctgtgcagatggagcacgaggggacgggcttcgttatcagccgcaactccgacttttctattaccgcgtgcacatggaccaacaagaagtggccgcacagcgctccggaggggaaaacacttctccgagcatacgtaggcaaggccggggacgagtcaattgttgagctctccgacaatgaaatcattaaaatagttctggaggatcttaagaaggtaatgaagataaagggggaacctgaaatgacgtgtgttacccgctggaatgagtcaatgccccagtaccatgtgggacacaagcagaggataaagaaggtgagggaggcgctcgctgcgtcctacccaggggtctacatgacaggagcgagttttgagggggtgggtattcccgactgtatcgaccagggtaagtcggcagtgtctgacgtgctcgcttacctattcgagtag

SEQ ID NO: 582 - DNA, 1422 bp, Artificial Sequence
  Recombinant
attgcagtcattggtggtgggataacagggttgtccgtggcctactacgtgaggaagctgcttcgggagcaaggcgttaatgcgggcgttaccctcgtcgagcaatccgaccgcctcggcgggaagattagatccttgagacgagacggctttaccattgagcaaggccctgactctatgattgcacgtaagcccgcagctctcgaacttatccgtgagcttggtctggaggacaagttggcgggcacaaaccctcaagccaaacgctcctacatactgcaccgtggcaagtttcatccgatgccacctgggctgatgctcgggattcccactcaaatgtggccaatggtcaagaccgggctgctatctccggccggaaagctacgggctgcgatggacctacttcttcctgcaaggcgcggaggcggcgacgaatcacttggtgggtttatccggaggcggcttggacgtgaggtgttggagcagatgaccgaaccactccttgctggaatctatgctggcgacacagaacagctttcacttaaagcgacctttcctcaattcatggagatggaaaggaaacatcgcagtctcatccttggactattggctgggaagaaacagccaccgcgtcccggtggtagccaagtgccgctcccaaaggccgctcagaccagtatgttcttgacactcaccggcgggttggaaggtctgaccgaagcactagaggaaagcctatcagaggagaagataattactggccaagcagttaccggactttcgcagcaagaggccgggtatgagttaaatctctctggcggagagagacttaatgcagacggagtgatcctcgcagtcccagcgttcgctgccgcccgacttcttgacggcgtgcctgaggccgcctacctagagcgcatccgctatgtcagtgttgctaatttggcgttcgcttacaggcgtgaggacgtgcctcatgatctgaatgggtccggcgtgttaatccctagaggtgaagggaggatgattacggccataacttgggtttcgtccaaatggttgcattcagcacccggtgacaaggcactgctgagagcgtacattgggcgactaggtgatgaggcttggacagccatgtgtagggccgacatcgagcgtagagtcgccgctgaactccgcgatctactaggaattgccgctagtcctttgttctgtgaactagccgcactcccagaatctatgccgcagtatccagtgggtcacgtcgaacgactcgaagccttgcgaggagcattgtgtcgcgctaaaccagggttgttgttgtgtggtgccgggtacgctggcgttggcattccagactgcattcggcaaggcaaagaagccgctgagtcgatggcggcttatttgagggacggacgctag

SEQ ID NO: 583 - DNA, 1464 bp, Artificial Sequence
  Recombinant
cttgtggtcatcggcggagggatcactgggctttcggccgccttctatgcactaaagcaagccgatgaggaagggcagcccatctcggtcaccataattgaacagagcgataggctcggcggaaagatccagacactccgcaaggagggctgcgtaattgagaagggcccggattccttcctcgctaggaagttgccgatgattgatctagctcgggatcttggcatggactccgaattggtggcgactaatccgcacgcaaagaagacttacatcttgaggcgcggaaagctctaccggatgcctccaggcttagtgcttggcatacctacggaactaggaccattcgctaagacagggctcattagcccttggggcaaactccgcgccgctatggatttgttcattaagcctcatccagccgatgaagacgaaagtgttggcgctttcctggacagacgtctcggtagggaagtgaccgagcacattgcggaacctttattggcgggcatctacgcgggcgacttgcaagccttaagccttcaagccactttcccacagtttgcacaagtagagcgcaagcacggagggctgatacgcggtatgaaggccagcagacaggccggtcagtccgtgcctgggctgccggacgtcgccaagggtacgatgttccttacctttcgcaacgggcttaccagcttagttgaaaggttggaggaaactctcagagacagggctgaactctgtctgggcatcggcgcagaagggtttgagaaacgtgaagatggaacataccttgttcgactaagcgatggttcgaggctccaggccgacgcagtaattgtcactacgccgagctatcatgcggcatccctgttggaggagcatgtggatgcttcggccctccaggccattcgtcatgtaagcgttgcaaatgtcgttagcgtcttcgaccgaaagcaagtgaataaccagttcgacggcacagggtttgttatctcacggcgagaaggtcgcgcaatcaccgcctgtacctggacatccgtgaaatggccgcatacttcgcgcggcgacaaactgattatccggtgctacatcggtagggctggcgacgaggagcgagtggattggcccgatgaagctctcaagcgtactgtaagatcagaactgcgtgagttgctggacattgacattgatccggaatttgtggagattacacgactcaggcactctatgcctcaatacccagtcggccacgtccaggctatccgctctttgagggacgaggtcggtaggactttaccgggcgtgttccttgctgggcaaccctacgaaggtgtgggaatgcctgactgtgtgaggtccggccgggatgccgccgaagcagcagtaagtgctatgcaagcaatgagtacagaaccagaagcaccggcagaggacgccgctactggaacggcgggttga

SEQ ID NO: 584 - DNA, 1404 bp, Artificial Sequence
  Recombinant
gttgttgttgttggcggcggcttgactggcctaagcgccgccttctacatccggaaacattatcgagaagctggagttgagcccgtcatcacgcttgttgagaaatctagctcgatgggagggatgattgagacccttcatagggacgggtttgtcatcgagaagggcccggacagtttcttggcacggaagaccgcaatgattgatctggcgaaagagctggagattgaccacgagttggtcagccagaatccagaatcgaagaagacctacataatgcaacgtggaaagctgcaccctatgccagcgggacttgttctgggcattcccaccgaattgcgtccctttctccggagcgggcttgtctcacccgctgggaagttgcgggcgctgatggacttcgtaataccgccacgaaggacgaccgaagatgagtcactcgggtacatgatcgagcgccgactgggtgccgaggtgttggagaacctcacagagccgttgctcgctggaatctacgctggcgacatgagaagattgtccctccaggctacgtttccgcagttcggtgaggtggagcgcgactacggctccttaatcagaggaatgatgaccggacgtaagcctgcggagacacacacagggaccaagaggtctgcctttctcaatttcagacagggtctgcaatcactggttcacgccttagtccatgaactccaggatgtagatcagaggttaaatactgcggtgaagtcgcttcagaggcttgacggcgcacaaacccgttatcgcgttgaactcggcaatggcgaaatgcttgaggctgacgacgtggtggttactgtaccaacctacgtggcgagcgagcttcttaagccgcacgtggacacggcggcgttagacgctattaactatgtgtcggtggctaatgtagttcttgcattcgagaagaaggaagtagagcacgtcttcgatggatcgggcttcttggtgcctcggaaggagggaaggaacataaccgcctgcacctggacttcgaccaagtggctccacacatcaccagatgacaaggttctgttacgttgttacgtgggcagaagtggagatgagcagaatgtggaactcccggatgaggcactcactaatctggtgcttaaggatctgagagagacgatgggcatcgaggcggttccaatcttctcagagattacccggctccgcaagtcaatgccgcagtacccagtaggacatctccagcacatcgccgcattgcgcgaggaactcggctctaagctaccaggagtgtacatcgccggagcgggctacgagggcgttggtcttccggattgcattcgccaggccaaagaaatgtcagtccaggcaacgcaagaactcgctgccgactga

SEQ ID NO: 585 - DNA, 1398 bp, Artificial Sequence; identical to SEQ ID NO: 581
  Recombinant

SEQ ID NO: 586 - protein, 181 aa, Escherichia coli; identical to SEQ ID NO: 320

SEQ ID NO: 587 - DNA, 546 bp, Escherichia coli; identical to SEQ ID NO: 442

SEQ ID NO: 588 - DNA, 546 bp, Artificial Sequence; identical to SEQ ID NO: 482
  Recombinant

SEQ ID NO: 589 - DNA, 546 bp, Artificial Sequence; identical to SEQ ID NO: 504
  Recombinant

SEQ ID NO: 590 - protein, 504 aa, Amaranthus tuberculatus; identical to SEQ ID NO: 468

SEQ ID NO: 591 - DNA, 1515 bp, Artificial Sequence
  Recombinant
atgggcaacattagcgaacgcgaagaaccgaccagcgcgaaacgcgtggcggtggtgggcgcgggcgtgagcggcctggcggcggcgtataagctgaagagccatggactgagtgtaaccctgttcgaagcggatagccgcgcaggcggcaagctgaagaccgtgaagaaggatggcttcatatgggatgaaggcgcgaacaccatgaccgagagcgaggcggaggtgagcagtctgatagatgatcttggccttcgcgagaagcagcaactgccgattagccagaacaaacgctatattgcgcgcgatggcctgccggtgctgctgccgagcaacccggcggcgctgctgaccagcaacattctgagcgcgaaaagcaaactgcagattatgctggaaccgtttctgtggcgcaaacataacgcgaccgaactgagcgatgaacatgtgcaggaaagcgtgggcgaattttttgaacgccattttggcaaagaatttgtggattatgtgattgatccgtttgtggcgggcacctgcggcggcgatccgcagagcctgagcatgcatcatacctttccggaagtgtggaacattgaaaaacgctttggcagcgtgtttgcgggcctgattcagagcacgctgctgagcaagaaagagaaaggaggcgagaacgcgagcattaaaaaaccgcgcgtgcgcggcagctttagctttcagggcggcatgcagaccctggtggataccatgtgcaaacagctgggcgaagatgaactgaaactgcagtgcgaagtgctgagcctgagctataaccagaaaggcattccgagcctgggcaactggagcgtgagcagcatgagcaacaacaccagcgaagatcagagctatgatgcggtggtggtgaccgcgccgattcgcaacgtgaaagagatgaagattatgaagttcggcaacccgttcagcctggattttattccggaagtgacctatgtgccgctgagcgtgatgattaccgcgtttaaaaaagataaagtgaaacgcccgctggaaggcttcggcgtgctgataccgagcaaggagcagcacaatggccttaagacccttggcactctgttcagcagtatgatgttcccggatcgcgcaccgagcgatatgtgcctgtttaccacctttgtgggcggcagccgcaaccgcaagctggcgaacgcgagcaccgatgaactgaagcagattgtgagcagcgatctgcagcaactgctgggcaccgaagatgaaccgagctttgtgaaccatctgttctggagcaacgcgtttccgctgtatggccataactatgatagcgtgctgcgcgcaattgataagatggaaaaggatctgccgggcttcttctatgcgggcaaccataaaggcggcctgagcgtgggcaaagcgatggcgagcggctgcaaagcggcggaactggtgattagctatctggatagccatatttatgtgaaaatggatgagaagaccgcgtga

SEQ ID NO: 592 - protein, 278 aa, Escherichia
MVIQSITHLSPNLALPSPLSVSTKNYPVAVMGNISEREEPTSAKRVAVVGAGVSGLAAAYKLKSHGLSVTLFEADSRAGGKLKTVKKDGFIWDEGANTKTLILFSTRDGQTREIASYLASELKELGIQADVANVHRIEEPQWENYDRVVIGASIRYGHYHSAFQEFVKKHATRLNSMPSAFYSVNLVARKPEKRTPQTNSYARKFLMNSQWRPDRCAVIAGALRYPRYRWYDRFMIKLIMKMSGGETDTRKEVVYTDWEQVANFAREIAHLTDKPTLK

SEQ ID NO: 593 - protein, 277 aa, Enterobacter cloacae
MVIQSITHLSPNLALPSPLSVSTKNYPVAVMGNISEREEPTSAKRVAVVGAGVSGLAAAYKLKSHGLSVTLFEADSRAGGKLKTVKKDGFIWDEGANTKTLILFSTRDGQTREIAAFLASELKEQGIYADVINLNRTEEIAWQEYDRVVIGASIRYGHFHPAVDRFVKKHTETLNSLPGAFFSVNLVARKAEKRTPQTNSYTRKFLLNSPWKPAACAVFAGALRYPRYRWYDRFMIRLIMKMTGGETDTRKEVVYTDWSQIASFAREIVQLTRSSRL

SEQ ID NO: 594 - protein, 276 aa, Enterobacter cloacae
MVIQSITHLSPNLALPSPLSVSTKNYPVAVMGNISEREEPTSAKRVAVVGAGVSGLAAAYKLKSHGLSVTLFEADSRAGGKLKTVKKDGFIWDEGANTKALVLYSTRDGQTHAIASYIASCMKEKAECDVIDLTHGEHVNLTQYDQVLIGASIRYGHFNAVLDKFIKRNVDQLNNMPSAFFCVNLTARKPEKRTPQTNPYVRKFLLATPWQPALCGVFAGALRYPRYRWIDKVMIQLIMRMTGGETDTSKEVEYTDWEQVKKFAEDFAKLSYKKAL

SEQ ID NO: 595 - protein, 276 aa, Enterobacter cloacae
MVIQSITHLSPNLALPSPLSVSTKNYPVAVMGNISEREEPTSAKRVAVVGAGVSGLAAAYKLKSHGLSVTLFEADSRAGGKLKTVKKDGFIWDEGANTKALVLYSTRDGQTHAIASYIASCMKEKAECDVIDLTHGEHVNLTQYDQVLIGANIRYGHFNAVLDKFIKRNVDQLNNMPSAFFCVNLTARKPEKRTPQTNPYVRKFLLATPWQPALCGVFAGALRYPRYRWIDKVMIQLIMRMTGGETDTSKEVEYTDWEQVKKFAEDFAKLSYKKAL

SEQ ID NO: 596 - protein, 270 aa, Enterobacter cloacae
MVIQSITHLSPNLALPSPLSVSTKNYPVAVMGNISEREEPTSAKRVAVVGAGVSGLAAAYKLKSHGLSVTLFEADSRAGGKLKTVKKDGFIWDEGANTKALVLYSTRDGQTHAIASYIASCMKEKAECDVIDLTHGEHVNLTQYDQVLIGASIRYGHFNAVLDKFIKRNVDQLNNMPSAFFCVNLTARKPEKRTPQTNPYVRKFLLATPWQPALCGVFAGALRYPRYRWIDKVMIQLIMRMTGGETDTSKEVEYTDWEQVKKFAEDFAKL

SEQ ID NO: 597 - protein, 276 aa, Pectobacterium carotovorum
MVIQSITHLSPNLALPSPLSVSTKNYPVAVMGNISEREEPTSAKRVAVVGAGVSGLAAAYKLKSHGLSVTLFEADSRAGGKLKTVKKDGFIWDEGANTKALIVFSSRDGQTRAIASYIANTLKGTLECDVVNVLNANDIDLSQYDRVAIGASIRYGRFHPAVNQFIRKHLTSLQQLPSAFFSVNLTARKPEKRTIQTNAYTRKFLLNSPWQPDLCCVFAGALRYPRYRWFDRVMIQLIMRITGGETDSTKEIEYTDWQQVARFAQDFAQLAAKNPA

SEQ ID NO: 598 - protein, 275 aa, Erwinia toletana
MVIQSITHLSPNLALPSPLSVSTKNYPVAVMGNISEREEPTSAKRVAVVGAGVSGLAAAYKLKSHGLSVTLFEADSRAGGKLKTVKKDGFIWDEGANTKALILFSSREGQTREIASYIANSIKEEMECDVFNILRVEQIDWSQYDRVLIGGSIHYGHFHPAVAKFVKRHLHELQQRSSGFFCVNLTARKADKRTPQTNAYMRKFLLQSPWQPDCCAVFAGALRYTRYRWFDRVMIQLIMRMTGGETDTSKEVEYTDWTQVARFAQEFAHLPGKTQ

SEQ ID NO: 599 - protein, 274 aa, Enterobacter mori
MVIQSITHLSPNLALPSPLSVSTKNYPVAVMGNISEREEPTSAKRVAVVGAGVSGLAAAYKLKSHGLSVTLFEADSRAGGKLKTVKKDGFIWDEGANTKILILFSTRDGQTREIAASLASELKEQAFDVDVVNLHRAENIAWEEYDGVVIGASIRYGHFHSTLNSFVKKHQQALKKLPGAFYSVNLVARKPEKRTPQTNSYTRKFLLDSPWQPDLSAVFAGALRYPRYNWYDRIMIRLIMKITGGETDTRKEVVYTDWQQVTHFAHEIVQLVRK

SEQ ID NO: 600 - protein, 275 aa, Pantoea ananatis
MVIQSITHLSPNLALPSPLSVSTKNYPVAVMGNISEREEPTSAKRVAVVGAGVSGLAAAYKLKSHGLSVTLFEADSRAGGKLKTVKKDGFIWDEGANTKALILFSTRDGQTQKIASAIADEIKGQQSCDVINIQDAKTLDWQQYDRVLIGASIRYGHFQPVVNEFVKHNLLALQQRVSGFFSVNLTARKPEKRSPETNAYTVKFLAQSPWQPDCCAVFAGALYYPRYRWFDRVMIQFIMRMTGGETDASKEVEYTDWQQVQRFARDFAQLPGKSY

SEQ ID NO: 601 - protein, 273 aa, Pantoea stewartii
MVIQSITHLSPNLALPSPLSVSTKNYPVAVMGNISEREEPTSAKRVAVVGAGVSGLAAAYKLKSHGLSVTLFEADSRAGGKLKTVKKDGFIWDEGANTKALILYSTRDGQTRKIASSIADVIRQQQQCDVLNIKDASLPDWAQYDRVLIGASIRYGHFQPVVDKFVKQHLHELQQRTSGFFSVNLTARKPEKRSPETNAYTQKFLAHSPWQPDCCAVFAGALYYPRYRWFDRVMIQLIMRMTGGETDSTKEVEYTDWQQVSTFANDFAQLPGK

SEQ ID NO: 602 - protein, 276 aa, Shimwellia blattae
MVIQSITHLSPNLALPSPLSVSTKNYPVAVMGNISEREEPTSAKRVAVVGAGVSGLAAAYKLKSHGLSVTLFEADSRAGGKLKTVKKDGFIWDEGANTKTLILFSTRDGQTHKIARHIAGVLEEQGKACELVDLLQPGEPDWSTVECVVLGASIRYGHFHKSFIRFVNTHAQRLNNMPGALFTVNLVARKPEKQSPQTNSYTRKFLAASPWQPQRCQVFAGALRYPRYSWYDRMMIRLIMKMAGGETDTRKEVEYTDWQSVTRFAREIAQLPGETR

SEQ ID NO: 603 - protein, 546 aa, Chitinophaga pinensis
MVIQSITHLSPNLALPSPLSVSTKNYPVAVMGNISEREEPTSAKRVAVVGAGVSGLAAAYKLKSHGLSVTLFEADSRAGGKLKTVKKDGFIWDEGANTMSDQPVLIVGAGLSGLSIAYELQKLQVPYQVLEVSGHSGGVMKSLRKDGFELDAGANTIAASPEILAYFTSLGLENEILQATAASKHRFLVRRRQLHAVSPHPFKIMSSPYLSRGSKWRLFTERFRKPVVASGEETVTDFITRRFNREIAEYVFDPVLSGIYAGNPDQMSIAEVLPALPRWEREYGSVTKGLMKDKGAMGGRKIISFKGGNQLLTNRLQQLLTTPVRFNCKVTGITASNGGYIVSAVEDGVSESYTASRVILTTPAYSAAATITNLDAATAALLNEIHYPRMGVLHLGFDATALPQPLDGFGFLVPNAENMHFLGAICNAAIFPDKAPPGKILFTVFLGGARQESLFDQMTPEALQQQVVSEVMSLLHLSAPPVMQHFSSWNKAIPQLNVGHVKLRRAVEAFEKKYPGIHLSGNYLQGVAIPALLQHAAALAASLKKN

SEQ ID NO: 604 - protein, 543 aa, Chitinophaga pinensis
MVIQSITHLSPNLALPSPLSVSTKNYPVAVMGNISEREEPTSAKRVAVVGAGVSGLAAAYKLKSHGLSVTLFEADSRAGGKLKTVKKDGFIWDEGANTQPVLIVGAGLSGLSIAYELQKLQVPYQVLEVSGHSGGVMKSLRKDGFELDAGANTIAASPEILAYFTSLGLENEILQATAASKHRFLVRRRQLHAVSPHPFKIMSSPYLSRGSKWRLFTERFRKPVVASGEETVTDFITRRFNREIAEYVFDPVLSGIYAGNPDQMSIAEVLPALPRWEREYGSVTKGLMKDKGAMGGRKIISFKGGNQLLTNRLQQLLTTPVRFNCKVTGITASNGGYIVSAVEDGVSESYTASRVILTTPAYSAAATITNLDAATAALLNEIHYPRMGVLHLGFDATALPQPLDGFGFLVPNAENMHFLGAICNAAIFPDKAPPGKILFTVFLGGARQESLFDQMTPEALQQQVVSEVMSLLHLSAPPVMQHFSSWNKAIPQLNVGHVKLRRAVEAFEKKYPGIHLSGNYLQGVAIPALLQHAAALAASLKKN

SEQ ID NO: 605 - protein, 546 aa, Chitinophaga pinensis
MVIQSITHLSPNLALPSPLSVSTKNYPVAVMGNISEREEPTSAKRVAVVGAGVSGLAAAYKLKSHGLSVTLFEADSRAGGKLKTVKKDGFIWDEGANTMSDQPVLIVGAGLSGLSIAYELQKLQVPYQVLEVSGHSGGVMKSLRKDGFELDAGANTIATSPEILAYFTSLGLENEILQATATSKHRFLVRRRQLHAVSPHPFKIMSSPYLCRGSKWRLFTERFRKPVVASGEETVTDFITRRFNREIAEYVFDPVLSGIYAGNPDQMSIAEVLPALPRWEREYGSVTKGLMKDKGAMGGRKIISFKGGNQLLTNRLQQLLTTPVRFNCKVTGITASNGGYIVSAVEDGVSESYTASRVILTTPAYSAAATITNLDAATAALLNEIHYPRMGVLHLGFDATALPQPLDGFGFLVPNAENMHFLGAICNAAIFPDKAPPGKILFTVFLGGARQESLFDQMTPEALQQQVVSEVMSLLHLSAPPVMQHFSSWNKAIPQLNVGHVKLRRAVEAFEKKYPGIHLSGNYLQGVAIPALLQHAAALAASLKKN

SEQ ID NO: 606 - protein, 543 aa, Chitinophaga pinensis
MVIQSITHLSPNLALPSPLSVSTKNYPVAVMGNISEREEPTSAKRVAVVGAGVSGLAAAYKLKSHGLSVTLFEADSRAGGKLKTVKKDGFIWDEGANTQPVLIVGAGLSGLSIAYELQKLQVPYQVLEVSGHSGGVMKSLRKDGFELDAGANTIATSPEILAYFTSLGLENEILQATATSKHRFLVRRRQLHAVSPHPFKIMSSPYLCRGSKWRLFTERFRKPVVASGEETVTDFITRRFNREIAEYVFDPVLSGIYAGNPDQMSIAEVLPALPRWEREYGSVTKGLMKDKGAMGGRKIISFKGGNQLLTNRLQQLLTTPVRFNCKVTGITASNGGYIVSAVEDGVSESYTASRVILTTPAYSAAATITNLDAATAALLNEIHYPRMGVLHLGFDATALPQPLDGFGFLVPNAENMHFLGAICNAAIFPDKAPPGKILFTVFLGGARQESLFDQMTPEALQQQVVSEVMSLLHLSAPPVMQHFSSWNKAIPQLNVGHVKLRRAVEAFEKKYPGIHLSGNYLQGVAIPALLQHAAALAASLKKN

SEQ ID NO: 607 - protein, 543 aa, Chitinophaga pinensis
MVIQSITHLSPNLALPSPLSVSTKNYPVAVMGNISEREEPTSAKRVAVVGAGVSGLAAAYKLKSHGLSVTLFEADSRAGGKLKTVKKDGFIWDEGANTQPVLIVGAGLSGLSIAYELQKLQVPYQVLEVSGHSGGVMKSLRKDGFELDAGANTIATSPEILAYFTSLGLENEILQATAASKHRFLVRRRQLHAVSPHPFKIMSSPYLSRGSKWRLFTERFRKPVVASGEETVTDFITRRFNREIAEYVFDPVLSGIYAGNPDQMSIAEVLPALPRWEREYGSVTKGLMKDKGAMGGRKIISFKGGNQLLTNRLQQLLTTPVRFNCKVTGITASNGGYIVSAVEDGVSESYTASRVILTTPAYSAAATITNLDAATAALLNEIHYPRMGVLHLGFDATALPQPLDGFGFLVPNAENMHFLGAICNAAIFPDKAPPGKILFTVFLGGARQESLFDQMTPEALQQQVVSEVMSLLHLSAPPVMQHFSSWNKAIPQLNVGHVKLRRAVEAFEKKYPGIHLSGNYLQGVAIPALLQHAAALAASLKKN

SEQ ID NO: 608 - protein, 543 aa, Chitinophaga pinensis
MVIQSITHLSPNLALPSPLSVSTKNYPVAVMGNISEREEPTSAKRVAVVGAGVSGLAAAYKLKSHGLSVTLFEADSRAGGKLKTVKKDGFIWDEGANTQPVLIVGAGLSGLSIAYELQKLQVPYQVLEVSGHSGGVMKSLRKDGFELDAGANTIATSPEILAYFTSLGLENEILQATATSKHRFLVRRRQLHAVSPHPFKIMSSPYLCRGSKWRLFTERFRKPVVASGEETVTDFITRRFNREIAEYVFDPVLSGIYAGNPDQMSIAEVLPALPRWEREYGSVTKGLMKDKGAMGGRKIISFKGGNQLLTNRLQQLLTTPVRFNCKVTGITASNGGYIVSAVEDGVSESYTASRVILTTPAYSAAATITNLDAATAALLNEIHYPRMGVLHLGFDATALPQPLDGFGFLVPNAENMHFLGAICNAAIFPDKAPPGKILFTVFLGGARQESLFDQMTPEALQQQVVSEVMSLLHLSAPPVMQHFSSWNKAIPQLNVGHVKLRRAVEAFEKKYPGIHLSGNYLQGVAITALLQHAAALAASLKKN

SEQ ID NO: 609 - protein, 543 aa, Chitinophaga pinensis
MVIQSITHLSPNLALPSPLSVSTKNYPVAVMGNISEREEPTSAKRVAVVGAGVSGLAAAYKLKSHGLSVTLFEADSRAGGKLKTVKKDGFIWDEGANTQPVLIVGAGLSGLSIAYELQKLQVPYQVLEVSGHSGGVMKSLRKDGFELDAGANTIATSPEILAYFTSLGLENEILQATATSKHRFLVRRRQLHAVSPHPFKIMSSPYLCRGSKWRLFTERFRKPVVASGEETVTDFITRRFNREIAEYVFDPVLSGIYAGNPDQMSIAEVLPALPRWEREYGSVTKGLMKDKGAMGGRKIISFKGGNQLLTNRLQQLLTTPVRFNYKVTGITASNGGYIVSAVEDGVSESYTASRVILTTPAYSAAATITNLDAATAALLNEIHYPRMGVLHLGFDATALPQPLDGFGFLVPNAENMHFLGAICNAAIFPDKAPPGKILFTVFLGGARQESLFDQMTPEALQQQVVSEVMSLLHLSAPPVMQHFSSWNKAIPQLNVGHVKLRRAVEAFEKKYPGIHLSGNYLQGVAIPALLQHAAALAASLKKN

SEQ ID NO: 610 - protein, 540 aa, Xanthomonas campestris
MVIQSITHLSPNLALPSPLSVSTKNYPVAVMGNISEREEPTSAKRVAVVGAGVSGLAAAYKLKSHGLSVTLFEADSRAGGKLKTVKKDGFIWDEGANTMQTQPVIIAGAGIAGLSIAYELQQKGIPYEIMEASSYAGGVVKSLHIDGYELDAGPNSLAASAAFMAYIDQLGLQDQVLEAAAASKNRFLVRNDKLHAVSPHPFKILQSAYISGGAKWRLFTERFRKAAAPEGEETVSSFVTRRFGKEINDYLFEPVLSGIYAGNPDLMSVGEVLPMLPQWEQKYGSVTQGLLKNKGAMGGRKIIAFKGGNATLTNRLQSLLSGKIRFNCAVTGVTRGADDYIVQYTENGNTAMLNASRVIFTTPAYSTAVAIQALDASLATHLSDVPYPRMGVLHLGFGAEARQKAPAGFGFLVPHAAGKHFLGAICNSAIFPSRVPTGKVLFTVFLGGARQEQLFDQLGPEKLQQTVVKELMELLGLTTPPEMQRFSEWNRAIPQLNVGYAQTRQQIGVFEQRYPGIRLAGNYVTGVAVPAIIQAAKGYC

SEQ ID NO: 611 - protein, 537 aa, Xanthomonas campestris
MVIQSITHLSPNLALPSPLSVSTKNYPVAVMGNISEREEPTSAKRVAVVGAGVSGLAAAYKLKSHGLSVTLFEADSRAGGKLKTVKKDGFIWDEGANTQPVIIAGAGIAGLSIAYELQQKGIPYEIMEASSYAGGVVKSLHIDGYELDAGPNSLAASAAFMAYIDQLGLQDQVLEAAAASKNRFLVRNDKLHAVSPHPFKILQSAYISGGAKWRLFTERFRKAAAPEGEETVSSFVTRRFGKEINDYLFEPVLSGIYAGNPDLMSVGEVLPMLPQWEQKYGSVTQGLLKNKGAMGGRKIIAFKGGNATLTNRLQSLLSGKIRFNCAVTGVTRGADDYIVQYTENGNTAMLNASRVIFTTPAYSTAVAIQALDASLATHLSDVPYPRMGVLHLGFGAEARQKAPAGFGFLVPHAAGKHFLGAICNSAIFPSRVPTGKVLFTVFLGGARQEQLFDQLGPEKLQQTVVKELMELLGLTTPPEMQRFSEWNRAIPQLNVGYAQTRQQIGVFEQRYPGIRLAGNYVTGVAVPAIIQAAKGYC

SEQ ID NO: 612 - protein, 568 aa, Bacillus atrophaeus
MVIQSITHLSPNLALPSPLSVSTKNYPVAVMGNISEREEPTSAKRVAVVGAGVSGLAAAYKLKSHGLSVTLFEADSRAGGKLKTVKKDGFIWDEGANTMSDGKKHLVIIGGGITGLASAFYMEKEIREKNLPLSVTLVEASPRVGGKIQTARKDGYIIERGPDSFLERKKSAPELVEDLGLEHLLVNNATGQSYVLVNETLHPMPKGAVMGIPTKIAPFMSTGLFSFSGKARAAMDFVLPASKPKEDQSLGEFFRRRVGDEVVENLIEPLLSGIYAGDIDRLSLMSTFPQFYQTEQKHRSLILGMKKTRPQGSGQRLTAKKQGQFQTLKTGLQTLVEELENQLKLTKVYKGTKVTNISRGEKGCSIALDNGMTLDADAAIVTSPHKSAAGMFPDLPAVSQLKDMHSTSVANVALGFPQEAVQMEHEGTGFVISRNSDFSITACTWTNKKWPHSAPEGKTLLRAYVGKAGDESIVELSDNEIIKIVLEDLKKVMKIKGEPEMTCVTRWNESMPQYHVGHKQRIKKVREALAASYPGVYMTGASFEGVGIPDCIDQGKSAVSDVLAYLFG

SEQ ID NO: 613 - protein, 568 aa, Bacillus atrophaeus
MVIQSITHLSPNLALPSPLSVSTKNYPVAVMGNISEREEPTSAKRVAVVGAGVSGLAAAYKLKSHGLSVTLFEADSRAGGKLKTVKKDGFIWDEGANTMSDGKKHLVIIGGGITGLASAFYMEKEIREKNLPLSVTLVEASPRVGGKIQTARKDGYIIERGPDSFLERKKSAPELVEDLGLEHLLVNNATGQSYVLVNETLHPMPKGAVMGIPTKIAPFMSTRLFSFSGKARAAMDFVLPASKPKEDQSLGEFFRRRVGDEVVENLIEPLLSGIYAGDIDRLSLMSTFPQFYQTEQKHRSLILGMKKTRPQGSGQQLTAKKQGQFQTLKTGLQTLVEELENQLKLTKVYKGTKVTNISRGEKGCSIALDNGMTLDADAAIVTSPHKSAAGMFPDLPAVSQLKDMHSTSVANVALGFPQEAVQMEHEGTGFVISRNSDFSITACTWTNKKWPHSAPEGKTLLRAYVGKAGDESIVELSDNEIIKIVLEDLKKVMKIKGEPEMTCVTRWNESMPQYHVGHKQRIKKVREALAASYPGVYMTGASFEGVGIPDCIDQGKSAVSDVLAYLFE

SEQ ID NO: 614 - protein, 562 aa, Bacillus atrophaeus
MVIQSITHLSPNLALPSPLSVSTKNYPVAVMGNISEREEPTSAKRVAVVGAGVSGLAAAYKLKSHGLSVTLFEADSRAGGKLKTVKKDGFIWDEGANTKHLVIIGGGITGLASAFYMEKEIREKNLPLSVTLVEASPRVGGKIQTARKDGYIIERGPDSFLERKKSAPELVEDLGLEHLLVNNATGQSYVLVNETLHPMPKGAVMGIPTKIAPFMSTRLFSFSGKARAAMDFVLPASKPKEDQSLGEFFRRRVGDEVVENLIEPLLSGIYAGDIDRLSLMSTFPQFYQTEQKHRSLILGMKKTRPQGSGQQLTAKKQGQFQTLKTGLQTLVEELENQLKLTKVYKGTKVTNISRGEKGCSIALDNGMTLDADAAIVTSPHKSAAGMFPDLPAVSQLKDMHSTSVANVALGFPQEAVQMEHEGTGFVISRNSDFSITACTWTNKKWPHSAPEGKTLLRAYVGKAGDESIVELSDNEIIKIVLEDLKKVMKIKGEPEMTCVTRWNESMPQYHVGHKQRIKKVREALAASYPGVYMTGASFEGVGIPDCIDQGKSAVSDVLAYLF

SEQ ID NO: 615 - protein, 561 aa, Bacillus atrophaeus
MVIQSITHLSPNLALPSPLSVSTKNYPVAVMGNISEREEPTSAKRVAVVGAGVSGLAAAYKLKSHGLSVTLFEADSRAGGKLKTVKKDGFIWDEGANTLVIIGGGITGLASAFYMEKEIREKNLPLSVTLVEASPRVGGKIQTARKDGYIIERGPDSFLERKKSAPELVEDLGLEHLLVNNATGQSYVLVNETLHPMPKGAVMGIPTKIAPFMSTRLFSFSGKARAAMDFVLPASKPKEDQSLGEFFRRRVGDEVVENLIEPLLSGIYAGDIDRLSLMSTFPQFYQTEQKHRSLILGMKKTRPQGSGQQLTAKKQGQFQTLKTGLQTLVEELENQLKLTKVYKGTKVTNISRGEKGCSIALDNGMTLDADAAIVTSPHKSAAGMFPDLPAVSQLKDMHSTSVANVALGFPQEAVQMEHEGTGFVISRNSDFSITACTWTNKKWPHSAPEGKTLLRAYVGKAGDESIVELSDNEIIKIVLEDLKKVMKIKGEPEMTCVTRWNESMPQYHVGHKQRIKKVREALAASYPGVYMTGASFEGVGIPDCIDQGKSAVSDVLAYLFE

SEQ ID NO: 616 - protein, 575 aa, Paenibacillus macerans
MVIQSITHLSPNLALPSPLSVSTKNYPVAVMGNISEREEPTSAKRVAVVGAGVSGLAAAYKLKSHGLSVTLFEADSRAGGKLKTVKKDGFIWDEGANTMSKKIAVIGGGITGLSVAYYVRKLLREQGVNAGVTLVEQSDRLGGKIRSLRRDGFTIEQGPDSMIARKPAALELIRELGLEDKLAGTNPQAKRSYILHRGKFHPMPPGLMLGIPTQMWPMVKTGLLSPAGKLRAAMDLLLPARRGGGDESLGGFIRRRLGREVLEQMTEPLLAGIYAGDTEQLSLKATFPQFMEMERKHRSLILGLLAGKKQPPRPGGSQVPLPKAAQTSMFLTLTGGLEGLTEALEESLSEEKIITGQAVTGLSQQEAGYELNLSGGERLNADGVILAVPAFAAARLLDGVPEAAYLERIRYVSVANLAFAYRREDVPHDLNGSGVLIPRGEGRMITAITWVSSKWLHSAPGDKALLRAYIGRLGDEAWTAMCRADIERRVAAELRDLLGIAASPLFCELAALPESMPQYPVGHVERLEALRGALCRAKPGLLLCGAGYAGVGIPDCIRQGKEAAESMAAYLRDGR

SEQ ID NO: 617 - protein, 573 aa, Paenibacillus macerans
MVIQSITHLSPNLALPSPLSVSTKNYPVAVMGNISEREEPTSAKRVAVVGAGVSGLAAAYKLKSHGLSVTLFEADSRAGGKLKTVKKDGFIWDEGANTKKIAVIGGGITGLSVAYYVRKLLREQGVNAGVTLVEQSDRLGGKIRSLRRDGFTIEQGPDSMIARKPAALELIRELGLEDKLAGTNPQAKRSYILHRGKFHPMPPGLMLGIPTQMWPMVKTGLLSPAGKLRAAMDLLLPARRGGGDESLGGFIRRRLGREVLEQMTEPLLAGIYAGDTEQLSLKATFPQFMEMERKHRSLILGLLAGKKQPPRPGGSQVPLPKAAQTSMFLTLTGGLEGLTEALEESLSEEKIITGQAVTGLSQQEAGYELNLSGGERLNADGVILAVPAFAAARLLDGVPEAAYLERIRYVSVANLAFAYRREDVPHDLNGSGVLIPRGEGRMITAITWVSSKWLHSAPGDKALLRAYIGRLGDEAWTAMCRADIERRVAAELRDLLGIAASPLFCELAALPESMPQYPVGHVERLEALRGALCRAKPGLLLCGAGYAGVGIPDCIRQGKEAAESMAAYLRDGR

SEQ ID NO: 618 - protein, 571 aa, Paenibacillus macerans
MVIQSITHLSPNLALPSPLSVSTKNYPVAVMGNISEREEPTSAKRVAVVGAGVSGLAAAYKLKSHGLSVTLFEADSRAGGKLKTVKKDGFIWDEGANTIAVIGGGITGLSVAYYVRKLLREQGVNAGVTLVEQSDRLGGKIRSLRRDGFTIEQGPDSMIARKPAALELIRELGLEDKLAGTNPQAKRSYILHRGKFHPMPPGLMLGIPTQMWPMVKTGLLSPAGKLRAAMDLLLPARRGGGDESLGGFIRRRLGREVLEQMTEPLLAGIYAGDTEQLSLKATFPQFMEMERKHRSLILGLLAGKKQPPRPGGSQVPLPKAAQTSMFLTLTGGLEGLTEALEESLSEEKIITGQAVTGLSQQEAGYELNLSGGERLNADGVILAVPAFAAARLLDGVPEAAYLERIRYVSVANLAFAYRREDVPHDLNGSGVLIPRGEGRMITAITWVSSKWLHSAPGDKALLRAYIGRLGDEAWTAMCRADIERRVAAELRDLLGIAASPLFCELAALPESMPQYPVGHVERLEALRGALCRAKPGLLLCGAGYAGVGIPDCIRQGKEAAESMAAYLRDGR

SEQ ID NO: 619 - protein, 572 aa, Paenibacillus macerans
MVIQSITHLSPNLALPSPLSVSTKNYPVAVMGNISEREEPTSAKRVAVVGAGVSGLAAAYKLKSHGLSVTLFEADSRAGGKLKTVKKDGFIWDEGANTMGDKKRRVVVVGGGLTGLSAAFYIRKHYREAGVEPVITLVEKSSSMGGMIETLHRDGFVIEKGPDSFLARKTAMIDLAKELEIDHELVSQNPESKKTYIMQRGKLHPMPAGLVLGIPTELRPFLRSGLVSPAGKLRALMDFVIPPRRTTEDESLGYMIERRLGAEVLENLTEPLLAGIYAGDMRRLSLQATFPQFGEVERDYGSLIRGMMTGRKPAETHTGTKRSAFLNFRQGLQSLVHALVHELQDVDQRLNTAVKSLQRLDGAQTRYRVELGNGEMLEADDVVVTVPTYVASELLKPHVDTAALDAINYVSVANVVLAFEKKEVEHVFDGSGFLVPRKEGRNITACTWTSTKWLHTSPDDKVLLRCYVGRSGDEQNVELPDEALTNLVLKDLRETMGIEAVPIFSEITRLRKSMPQYPVGHLQHIAALREELGSKLPGVYIAGAGYEGVGLPDCIRQAKEMSVQATQELAAD

SEQ ID NO: 620 - protein, 562 aa, Paenibacillus macerans
MVIQSITHLSPNLALPSPLSVSTKNYPVAVMGNISEREEPTSAKRVAVVGAGVSGLAAAYKLKSHGLSVTLFEADSRAGGKLKTVKKDGFIWDEGANTRRVVVVGGGLTGLSAAFYIRKHYREAGVEPVITLVEKSSSMGGMIETLHRDGFVIEKGPDSFLARKTAMIDLAKELEIDHELVSQNPESKKTYIMQRGKLHPMPAGLVLGIPTELRPFLRSGLVSPAGKLRALMDFVIPPRRTTEDESLGYMIERRLGAEVLENLTEPLLAGIYAGDMRRLSLQATFPQFGEVERDYGSLIRGMMTGRKPAETHTGTKRSAFLNFRQGLQSLVHALVHELQDVDQRLNTAVKSLQRLDGAQTRYRVELGNGEMLEADDVVVTVPTYVASELLKPHVDTAALDAINYVSVANVVLAFEKKEVEHVFDGSGFLVPRKEGRNITACTWTSTKWLHTSPDDKVLLRCYVGRSGDEQNVELPDEALTNLVLKDLRETMGIEAVPIFSEITRLRKSMPQYPVGHLQHIAALREELGSKLPGVYIAGAGYEGVGLPDCIRQAKEMSVQATQ

SEQ ID NO: 621 - protein, 562 aa, Paenibacillus macerans
MVIQSITHLSPNLALPSPLSVSTKNYPVAVMGNISEREEPTSAKRVAVVGAGVSGLAAAYKLKSHGLSVTLFEADSRAGGKLKTVKKDGFIWDEGANTVVVVGGGLTGLSAAFYIRKHYREAGVEPVITLVEKSSSMGGMIETLHRDGFVIEKGPDSFLARKTAMIDLAKELEIDHELVSQNPESKKTYIMQRGKLHPMPAGLVLGIPTELRPFLRSGLVSPAGKLRALMDFVIPPRRTTEDESLGYMIERRLGAEVLENLTEPLLAGIYAGDMRRLSLQATFPQFGEVERDYGSLIRGMMTGRKPAETHTGTKRSAFLNFRQGLQSLVHALVHELQDVDQRLNTAVKSLQRLDGAQTRYRVELGNGEMLEADDVVVTVPTYVASELLKPHVDTAALDAINYVSVANVVLAFEKKEVEHVFDGSGFLVPRKEGRNITACTWTSTKWLHTSPDDKVLLRCYVGRSGDEQNVELPDEALTNLVLKDLRETMGIEAVPIFSEITRLRKSMPQYPVGHLQHIAALREELGSKLPGVYIAGAGYEGVGLPDCIRQAKEMSVQATQEL

SEQ ID NO: 622 - protein, 591 aa, Paenibacillus macerans
MVIQSITHLSPNLALPSPLSVSTKNYPVAVMGNISEREEPTSAKRVAVVGAGVSGLAAAYKLKSHGLSVTLFEADSRAGGKLKTVKKDGFIWDEGANTMKALRKLVVIGGGITGLSAAFYALKQADEEGQPISVTIIEQSDRLGGKIQTLRKEGCVIEKGPDSFLARKLPMIDLARDLGMDSELVATNPHAKKTYILRRGKLYRMPPGLVLGIPTELGPFAKTGLISPWGKLRAAMDLFIKPHPADEDESVGAFLDRRLGREVTEHIAEPLLAGIYAGDLQALSLQATFPQFAQVERKHGGLIRGMKASRQAGQSVPGLPDVAKGTMFLTFRNGLTSLVERLEETLRDRAELCLGIGAEGFEKREDGTYLVRLSDGSRLQADAVIVTTPSYHAASLLEEHVDASALQAIRHVSVANVVSVFDRKQVNNQFDGTGFVISRREGRAITACTWTSVKWPHTSRGDKLIIRCYIGRAGDEERVDWPDEALKRTVRSELRELLDIDIDPEFVEITRLRHSMPQYPVGHVQAIRSLRDEVGRTLPGVFLAGQPYEGVGMPDCVRSGRDAAEAAVSAMQAMSTEPEAPAEDAATGTAG

SEQ ID NO: 623 - protein, 587 aa, Paenibacillus macerans
MVIQSITHLSPNLALPSPLSVSTKNYPVAVMGNISEREEPTSAKRVAVVGAGVSGLAAAYKLKSHGLSVTLFEADSRAGGKLKTVKKDGFIWDEGANTRKLVVIGGGITGLSAAFYALKQADEEGQPISVTIIEQSDRLGGKIQTLRKEGCVIEKGPDSFLARKLPMIDLARDLGMDSELVATNPHAKKTYILRRGKLYRMPPGLVLGIPTELGPFAKTGLISPWGKLRAAMDLFIKPHPADEDESVGAFLDRRLGREVTEHIAEPLLAGIYAGDLQALSLQATFPQFAQVERKHGGLIRGMKASRQAGQSVPGLPDVAKGTMFLTFRNGLTSLVERLEETLRDRAELCLGIGAEGFEKREDGTYLVRLSDGSRLQADAVIVTTPSYHAASLLEEHVDASALQAIRHVSVANVVSVFDRKQVNNQFDGTGFVISRREGRAITACTWTSVKWPHTSRGDKLIIRCYIGRAGDEERVDWPDEALKRTVRSELRELLDIDIDPEFVEITRLRHSMPQYPVGHVQAIRSLRDEVGRTLPGVFLAGQPYEGVGMPDCVRSGRDAAEAAVSAMQAMSTEPEAPAEDAATGTAG

SEQ ID NO: 624 - protein, 585 aa, Paenibacillus macerans
MVIQSITHLSPNLALPSPLSVSTKNYPVAVMGNISEREEPTSAKRVAVVGAGVSGLAAAYKLKSHGLSVTLFEADSRAGGKLKTVKKDGFIWDEGANTLVVIGGGITGLSAAFYALKQADEEGQPISVTIIEQSDRLGGKIQTLRKEGCVIEKGPDSFLARKLPMIDLARDLGMDSELVATNPHAKKTYILRRGKLYRMPPGLVLGIPTELGPFAKTGLISPWGKLRAAMDLFIKPHPADEDESVGAFLDRRLGREVTEHIAEPLLAGIYAGDLQALSLQATFPQFAQVERKHGGLIRGMKASRQAGQSVPGLPDVAKGTMFLTFRNGLTSLVERLEETLRDRAELCLGIGAEGFEKREDGTYLVRLSDGSRLQADAVIVTTPSYHAASLLEEHVDASALQAIRHVSVANVVSVFDRKQVNNQFDGTGFVISRREGRAITACTWTSVKWPHTSRGDKLIIRCYIGRAGDEERVDWPDEALKRTVRSELRELLDIDIDPEFVEITRLRHSMPQYPVGHVQAIRSLRDEVGRTLPGVFLAGQPYEGVGMPDCVRSGRDAAEAAVSAMQAMSTEPEAPAEDAATGTAG

The invention claimed is:

1. A recombinant chimeric nucleic acid molecule comprising a nucleic acid sequence encoding a dual transit peptide operably linked to a heterologous nucleic acid sequence encoding a heterologous polypeptide of interest,
  wherein said dual transit peptide is from the genus *Amaranthus* and translocates the polypeptide of interest to a chloroplast or a mitochondrion,
  wherein said dual transit peptide comprises an amino acid sequence having 100% sequence identity to SEQ ID NO: 1,
  wherein said heterologous polypeptide of interest is a polypeptide which, when overexpressed in a plant, confers herbicide tolerance to said plant,
  wherein said heterologous polypeptide of interest is from a prokaryote,
  wherein said polypeptide has protoporphyrinogen oxidase (PPO) activity and confers tolerance to PPO-inhibiting herbicides, and
  wherein said polypeptide having PPO activity comprises an amino acid sequence having 100% sequence identity to SEQ ID NO: 320.

2. An expression cassette comprising the nucleic acid molecule of claim 1, operably linked to a promoter which drives expression in a plant.

3. A plant cell comprising the expression cassette as defined in claim 2.

4. A plant or plant part comprising the plant cell of claim 3.

5. A seed obtained from the plant of claim 4, wherein the seed comprises the expression cassette.

6. A method for expressing a nucleic acid encoding a polypeptide of interest in a plant comprising (a) introducing into a plant cell the nucleic acid molecule of claim 1, and (b) regenerating a plant therefrom that comprises the nucleic acid molecule, wherein the plant expresses the polypeptide encoded by the recombinant chimeric nucleic acid molecule.

7. A method for producing a PPO-inhibiting herbicide tolerant plant comprising (a) introducing into a plant cell the nucleic acid molecule of claim 1, and (b) regenerating a plant therefrom that comprises the nucleic acid molecule, wherein the plant expresses the polypeptide encoded by the recombinant chimeric nucleic acid molecule.

8. A method for controlling undesired vegetation at a plant cultivation site, the method comprising the steps of:
  a) providing at that site a PPO-inhibiting herbicide tolerant plant that comprises the nucleic acid molecule of claim 1; and
  b) applying to that site an effective amount of a PPO-inhibiting herbicide, wherein the effective amount of said herbicide does not kill or inhibit the growth of the herbicide-tolerant plant of a).

9. A method for growing the plant as defined in claim 4 while controlling weeds in the vicinity of said plant, said method comprising the steps of:
  a) growing said plant; and
  b) applying a herbicide composition comprising a PPO-inhibiting herbicide to the plant and weeds,
  wherein the herbicide inhibits protoporphyrinogen oxidase, at a level of the herbicide that would inhibit the growth of a corresponding wild-type plant.

\* \* \* \* \*